US009279163B2

(12) United States Patent
Montalibet et al.

(10) Patent No.: US 9,279,163 B2
(45) Date of Patent: Mar. 8, 2016

(54) CELLOBIOHYDROLASE ENZYMES

(75) Inventors: Jacqueline Montalibet, Manotick (CA); Loreta Gudynaite-Savitch, Kanata (CA); Christopher Hill, Nepean (CA); Christopher D. Hindle, Gloucester (CA); James A. Lavigne, Nepean (CA); Nabil Masri, Gatineau (CA); Fuad Tahna, Ottawa (CA); John J. Tomashek, Ottawa (CA)

(73) Assignee: IOGEN ENERGY CORPORATION, Ontario (CA)

( * ) Notice: Subject to any disclaimer, the term of this patent is extended or adjusted under 35 U.S.C. 154(b) by 160 days.

(21) Appl. No.: 13/593,735

(22) Filed: Aug. 24, 2012

(65) Prior Publication Data

US 2013/0052694 A1 Feb. 28, 2013

Related U.S. Application Data

(60) Provisional application No. 61/529,333, filed on Aug. 31, 2011.

(51) Int. Cl.
*C12N 9/42* (2006.01)
*C12N 15/80* (2006.01)
*C12P 19/14* (2006.01)

(52) U.S. Cl.
CPC ........ *C12Y 302/01091* (2013.01); *C12N 9/2437* (2013.01); *C12N 15/80* (2013.01); *C12P 19/14* (2013.01)

(58) Field of Classification Search
CPC ...... C12N 15/63; C12N 15/80; C12N 9/2437; C12Y 302/01091; C12P 19/14
See application file for complete search history.

(56) References Cited

U.S. PATENT DOCUMENTS

| | | | |
|---|---|---|---|
| 7,375,197 B2 * | 5/2008 | Adney et al. | 536/23.1 |
| 7,452,707 B2 | 11/2008 | Goedegebuur et al. | |
| 7,459,299 B2 | 12/2008 | Goedegebuur et al. | |
| 7,951,570 B2 | 5/2011 | Goedegebuur et al. | |
| 7,951,571 B2 | 5/2011 | Goedegebuur et al. | |
| 7,972,832 B2 | 7/2011 | Day et al. | |
| 7,998,711 B2 | 8/2011 | Goedegebuur et al. | |
| 8,232,080 B2 | 7/2012 | Day et al. | |
| 8,236,546 B2 | 8/2012 | Goedegebuur et al. | |
| 2005/0054039 A1 | 3/2005 | Goedegebuur et al. | |
| 2005/0277172 A1 | 12/2005 | Day et al. | |
| 2007/0173431 A1 | 7/2007 | Day et al. | |
| 2009/0075336 A1 | 3/2009 | Goedegebuur et al. | |
| 2009/0163397 A1 | 6/2009 | Goedegebuur et al. | |
| 2009/0233335 A1 | 9/2009 | Goedegebuur et al. | |
| 2010/0221778 A1 | 9/2010 | Scott et al. | |
| 2011/0177561 A1 | 7/2011 | Goedegebuur et al. | |
| 2011/0229956 A1 | 9/2011 | Day et al. | |
| 2011/0294165 A1 | 12/2011 | Goedegebuur et al. | |
| 2012/0003703 A1 | 1/2012 | Mitchell et al. | |
| 2012/0270270 A1 | 10/2012 | Goedegebuur et al. | |
| 2012/0270298 A1 | 10/2012 | Day et al. | |

FOREIGN PATENT DOCUMENTS

| | | |
|---|---|---|
| CA | 2 750 920 A1 | 9/2010 |
| WO | 2004/016760 | 2/2004 |
| WO | 2005/001065 | 1/2005 |
| WO | 2005/028636 | 3/2005 |
| WO | 2012048171 | 4/2012 |
| WO | 2012051055 | 4/2012 |

OTHER PUBLICATIONS

Arnold et al., "Optimizing Industrial Enzymes by Directed Evolution", Adv. Biochem. Eng. Biotechnol., vol. 58 (1997) 1-14.
Bae et al., "Prediction of Protein Interdomain Linker Regions by a Nonstationary Hidden Markov Model", J. Amer. Stat. Assn., vol. 103, No. 483 (2008) 1085-89.
Barr et al., "Identification of Two Functionally Different Classes of Exocellulases", Biochemistry, vol. 35 (1996) 586-92.
Becker et al., "Engineering of a glycosidase Family 7 cellobiohydrolase to more alkaline pH optimum: the pH behaviour of Trichoderma reesei Cel7A and its E223S/A224H/L225V/T226A/D262G mutant", Biochem. J., vol. 356 (2001) 19-30.
Boer et al., "The relationship between thermal stability and pH optimum studied with wild-type and mutant Trichoderma cellobiohydrolase Cel7A", Eur. J. Biochem., vol. 270 (2003) 841-48.
Cantarel et al., "The Carbohydrate-Active EnZymes database (CAZy): an expert resource for Glycogenomics", Nucleic Acids Res., vol. 37 (2009) D233-38.
Coutinho et al., "Carbohydrate-active Enzymes: an Integrated Database Approach", Recent Advances in Carbon Bioengineering, The Royal Society of Chemistry, Cambridge (1999) 3-12.
Davies et al., "Oligosaccharide specificity of a family 7 endoglucanase: insertion of potential sugar-binding subsites", J Biotechnol., vol. 57 (1997) 91-100.
Davies et al., "Structures and mechanisms of glycosyl hydrolases", Structure, vol. 3, No. 9 (1995) 853-59.
Din et al., "C1-Cx revisited: Intramolecular synergism in a cellulase", Proc. Natl. Acad. Sci., vol. 91 (1994) 11383-387.
Divne et al., "The Three-Dimensional Structure of the Catalytic Core Domain of Cellobiohydrolase I from Trichoderma reesei", Science, vol. 265, No. 6171 (1994) 524-28.
Fox et al., "Optimizing the search algorithm for protein engineering by directed evolution", Prot. Eng., vol. 16, No. 8 (2003) 589-97.

(Continued)

*Primary Examiner* — Suzanne M Noakes
(74) *Attorney, Agent, or Firm* — Fitzpatrick, Cella, Harper & Scinto

(57) ABSTRACT

Provided are isolated cellobiohydrolases comprising a modified Glycoside Hydrolase (GH) Family 7 catalytic domain, a GH Family 7 catalytic domain and a modified Family 1 carbohydrate binding module (CBM), or both a modified Family 7 catalytic domain and a modified Family 1 CBM. Such isolated cellobiohydrolases exhibit from 45% to about 99.9% amino acid sequence identity to amino acids 1-436 of SEQ ID NO: 1 or to amino acids 1-438 of SEQ ID NO: 2 and improved activity on process substrates. Also provided are genetic constructs and genetically modified microbes for expressing the isolated cellobiohydrolases, a process for producing the isolated cellobiohydrolases, cellulase enzyme mixtures comprising the isolated cellobiohydrolase and a process for hydrolyzing a cellulosic substrate with such cellulase enzyme mixtures.

25 Claims, 19 Drawing Sheets

(56) References Cited

OTHER PUBLICATIONS

Gilkes et al., "Domains in Microbial β-1,4-Glycanases: Sequence Conservation, Function, and Enzyme Families", Microbiology Reviews, vol. 55, No. 2 (1991) 303-15.

Grassick et al., "Three-dimensional structure of a thermostable native cellobiohydrolase, CBH 1B, and molecular characterization of the cel7 gene from the filamentous fungus, Talaromyces emersonii", Eur. J. Biochem., vol. 271, (2004) 4495-506.

Heinzelman et al., "Efficient screening of fungal cellobiohydrolase class I enzymes for thermostabilizing sequence blocks by SCHEMA structure-guided recombination", Protein Eng., Des. Select., vol. 23, No. 11 (2010) 871-80.

Heinzelman et al., "A family of thermostable fungal cellulases created by structure-guided recombination", Proc. Natl. Acad. Sci., vol. 106, No. 14 (2009) 5610-615.

Kim et al., "Bacterial Cell Surface Display of an Enzyme Library for Selective Screening of Improved Cellulase Variants", Appl. Environ. Microbiol., vol. 66, No. 2 (2000) 788-93.

Kleywegt et al., "The Crystal Structure of the Catalytic Core Domain of Endoglucanase I from Trichoderma reesei at 3.6 Å Resolution, and a Comparison with Related Enzymes", J. Biol. Chem., vol. 272 (1997) 383-97.

Kurašin et al., "Processivity of Cellobiohydrolases is Limited by the Substrate", J. Biol. Chem., vol. 286, No. 1 (2011) 169-77.

Lehmann et al., "The consensus concept for thermostability engineering of proteins", Biochim. Biophys. Acta., vol. 1543 (2000) 408-15.

Lehmann et al., "Engineering proteins for thermostability: the use of sequence alignments versus rational design and directed evolution", Curr. Opin. Biotechno., vol. 12 (2001) 371-75.

Linder et al., "Design of a pH-dependent cellulose-binding domain", FEBS Letters, vol. 447 (1999) 13-6.

Muñoz et al., "Family 7 Cellobiohydrolases from Phanerochaete chrysosporium: Crystal Structure of the Catalytic Modules of Cel7D (CBH58) at 1.32 Å Resolution and Homology Models of the Isozymes", J. Mol. Biol., vol. 314 (2001) 1097-111.

Parkkinen et al., "Crystal Structure of Melanocarpus albomyces cellobiohydrolase Cel7B in complex with cello-oligomers show high flexibility in the substrate binding", Protein Science, vol. 17 (2008) 1383-94.

Reinikainen et al., "Effects of pH and High Ionic Strength on the Adsorption and Activity of Native and Mutated Cellobiohydrolase I from Trichoderma reesei", Proteins, vol. 22 (1995) 392-403.

Reinikainen et al., "Investigation of the Function of Mutated Cellulose-Binding Domains of Trichoderma reesei Cellobiohydrolase I", Proteins, vol. 14 (1992) 475-82.

Silberg et al., "SCHEMA-Guided Protein Recombination", Methods Enzymol., vol. 388 (2004) 35-42.

Srisodsuk et al., "Role of the Interdomain Linker Peptide of Trichoderma reesei Cellobiohydrolase I in Its Interaction with Crystalline Cellulose", J. Biol. Chem., vol. 268, No. 28 (1993) 20756-761.

Sulzenbacher et al., "Structure of the Fusarium oxysporum Endoglucanase I with a Nonhydrolyzable Substrate Analogue: Substrate Distortion Gives Rise to the Preferred Axial Orientation for the Leaving Group", Biochemistry, vol. 35, No. 48 (1996) 15280-287.

Suyama et al., "DomCut: prediction of inter-domain linker regions in amino acid sequences", Bioinformatics, vol. 19, No. 5 (2003) 673-74.

Teeri et al., "Trichoderma reesei cellobiohydrolases: why so efficient on crystalline cellulose", Biochemical Society Transactions, vol. 26 (1998) 173-78.

Teeri, et al., "Structure, function and genetics of cellulases," Biotechnology, vol. 21 (1992) 417-45.

Voutilainen et al., "Improving the thermostability and activity of Melanocarpus albomyces cellobiohydrolase Cel7B", Appl Microbiol Biotechnol, vol. 83 (2009) 261-72.

Voutilainen, et al., "Heterologous expression of Melanocarpus albomyces cellobiohydrolase Cel7B, and random mutagenesis to improve its thermostability", Enz. Microbial Technol., vol. 41 (2007) 234-43.

Voutilainen, et al., "Expression of Talaromyces emersonii cellobiohydrolase Cel7A in Saccharomyces cerevisiae and rational mutagenesis to improve its thermostability and activity", Prot. Eng. Des. Select., vol. 23, No. 2 (2010) 69-79.

Wolfahrt, et al., "Probing pH-Dependent Functional Elements in Proteins: Modifications of Carboxylic Acid Pairs in Trichoderma reesei Cellobiohydrolase Cel6A", Biochemistry, vol. 42 (2003) 10095-103.

\* cited by examiner

```
SEQ ID NO:   1    1  QSACTLQSETHPPLTWQKCS--SGGTCTQQTGSVVIDANW  38
SEQ ID NO: 447       QQAGTLTAETHPSLTWQKCT--SGGSCTTVNGSVVIDANW
SEQ ID NO: 448       QSACTLQSETHPPLTWQKCS--SGGTCTQQTGSVVIDANW
SEQ ID NO: 449       QSACTLQSETHPPLTWQKCS--SGGTCTQQTGSVVIDANW
SEQ ID NO: 450       QSACTLQAETHPPLTWQKCS--SGGTCTQQTGSVVIDANW
SEQ ID NO: 451       QSACTLQAETHPPLTWQKCS--SGGTCTQQTGSVVIDANW
SEQ ID NO: 452       QQAGTLTEEVHPSLTWQKCT--SEGSCTEQSGSVVIDSNW
SEQ ID NO: 453       QQAGTATAENHPPLTWQECT--APGSCTTQNGAVVLDANW
SEQ ID NO: 454       QQAGTVTAENHPSLTWQQCS--SGGSCTTQNGKVVIDANW
SEQ ID NO: 455       QQIGTYTAETHPSLSWSTCK--SGGSCTTNSGAITLDANW
SEQ ID NO: 456       HEAGTVTAENHPSLTWQQCS--SGGSCTTQNGKVVIDANW
SEQ ID NO: 457       QAACSLTAETHPSLQWQKCT--APGSCTTVSGQVTIDANW
SEQ ID NO: 458       QQIGTYTAETHPSLSWSTCK--SGGSCTTNSGAITLDANW
SEQ ID NO: 459       QQVGTYTTETHPSLTWQTCT--SDGSCTTNDGEVVIDANW
SEQ ID NO: 460       QQVGTLTAETHPALTWSKCT--AGX-CSQVSGSVVIDANW
SEQ ID NO: 461       QNACTLTAENHPSLTWSKCT--SGGSCTSVQGSITIDANW
SEQ ID NO: 462       QQVGTSTAEVHPSLTWQKCT--AGGSCTSQSGKVVIDSNW
SEQ ID NO: 463       QQVGTYTAETHPSLTWQTCS--GSGSCTTTSGSVVIDANW
SEQ ID NO: 464       QKVGTQQAEVHPGLTWQTCT--SSGSCTTVNGEVTIDANW
SEQ ID NO: 465       QKVGTQQAEVHPGLTWQTCT--SSGSCTTVNGEVTIDANW
SEQ ID NO: 466       QAVCSLTAETHPSLTWQKCT--APGSCTNVAGSITIDANW
SEQ ID NO: 467       QQACSLTAENHPSLTWKRCT--SGGSCSTVNGAVTIDANW
SEQ ID NO: 468       QQACSLTTETHPRLTWKRCT--SGGNCSTVNGAVTIDANW
SEQ ID NO: 469       QGVGTQQTETHPKLTFQKCS--AAGSCTTQNGEVVIDANW
SEQ ID NO: 470       QQACSLTTERHPSLSWNKCT--AGGQCQTVQASITLDSNW
SEQ ID NO: 471       QQACSLTTERHPSLSWKKCT--AGGQCQTVQASITLDSNW
SEQ ID NO: 472       QQACSSKPETHPPLSWSRCS--RSG-CRSVQGAVTVDANW
SEQ ID NO: 473       QQVGTSTAENHPKLTWQTCTGTGGTNCSNKSGSVVLDSNW
SEQ ID NO: 474       QQVGTNTAENHRTLTSQKCT--KSGGCSNLNTKIVLDANW
SEQ ID NO: 475       QQVGTQTAETHPKLTTQKCT--TAGGCTDQSTSIVLDANW
SEQ ID NO: 476       QQVGTNQAENHPSLPSQKCT--ASG-CTTSSTSVVLDANW
SEQ ID NO: 477       QQAGTNTAENHPQLQSQQCT--TSGGCKPLSTKVVLDSNW
SEQ ID NO: 478       QQVGTQMAEVHPKLPSQLCT--KSG-CTNQNTAVVLDANW
SEQ ID NO: 479       QQAGTITAENHPRMTWKRCS--GPGNCQTVQGEVVIDANW
SEQ ID NO: 480       QRAGTQQTETHPRLSWKRCS--SGGNCQTVNAEIVIDANW
SEQ ID NO: 481       QQAGTITAENHPRMTWKRCS--GPGNCQTVQGEVVIDANW
SEQ ID NO: 482       QQVGTNEPEVHPKMTWKKCS--SGGSCSTVNGEVVIDGNW
SEQ ID NO: 483       QRAGNETPENHPPLTWQRCT--APGNCQTVNAEVVIDANW
SEQ ID NO: 484       QQVGTYIPENHPLLATQSCT--ASGGCTTSSSKIVLDANR
SEQ ID NO: 485       QQAGTLQTKNHPSLTSQKCR---QGGCPQVNTTIVLDANW
```

Figure 3a-1

| | | |
|---|---|---|
| SEQ ID NO: 1 | 39 | RWTHATNSSTNCYDGNTWSSTLCPDNETCAKNCCLDGA-A 77 |
| SEQ ID NO: 447 | | RWTHTTNGSTNCYTGNTWDTSICPDGETCAQNCALDGA-D |
| SEQ ID NO: 448 | | RWTHATNSSTNCYDGNTWSSTLCPDNETCAKNCCLDGA-A |
| SEQ ID NO: 449 | | RWTHATNSSTNCYDGNTWSSTLCPDNETCAKNCCLDGA-A |
| SEQ ID NO: 450 | | RWTHATNSSTNCYDGNTWSSTLCPDNETCAKNCCLDGA-A |
| SEQ ID NO: 451 | | RWTHATNSSTNCYDGNTWSSTLCPDNETCAKNCCLDGA-A |
| SEQ ID NO: 452 | | RWTHSVNDSTNCYTGNTWDATLCPDDETCAANCALDGA-D |
| SEQ ID NO: 453 | | RWVHDVNGYTNCYTGNTWDPTYCPDDETCAQNCALDGA-D |
| SEQ ID NO: 454 | | RWVHTTSGYTNCYTGNTWDTSICPDDVTCAQNCALDGA-D |
| SEQ ID NO: 455 | | RWVHGVNTSTNCYTGNTWNSAICDTDASCAQDCALDGA-D |
| SEQ ID NO: 456 | | RWVHTTSGYTNCYTGNTWDTSICPDDVTCAQNCALDGA-D |
| SEQ ID NO: 457 | | RWLHQTNSSTNCYTGNEWDTSICSSDTDCATKCCLDGA-D |
| SEQ ID NO: 458 | | RWVHGVNTSTNCYTGNTWNTAICDTDASCAQDCALDGA-D |
| SEQ ID NO: 459 | | RWVHSTSSATNCYTGNEWDTSICTDDVTCAANCALDGA-T |
| SEQ ID NO: 460 | | PXVHSTSGSTNCYTGNTWDATLCPDDVTCAANCAVDGA-R |
| SEQ ID NO: 461 | | RWTHRTDSATNCYEGNKWDTSYCSDGPSCASKCCIDGA-D |
| SEQ ID NO: 462 | | RWVHNTGGYTNCYTGNDWDRTLCPDDVTCATNCALDGA-D |
| SEQ ID NO: 463 | | RWVHEVGGYTNCYSGNTWDSSICSTDTTCASECALEGA-T |
| SEQ ID NO: 464 | | RWLHTVNGYTNCYTGNEWDTSICTSNEVCAEQCAVDGA-N |
| SEQ ID NO: 465 | | RWLHTVNGYTNCYTGNEWDTSICTSNEVCAEQCAVDGA-N |
| SEQ ID NO: 466 | | RWTHQTSSATNCYSGSKWDSSICTTGTDCASKCCIDGA-E |
| SEQ ID NO: 467 | | RWTHTVSGSTNCYTGNQWDTSLCTDGKSCAQTCCVDGA-D |
| SEQ ID NO: 468 | | RWTHTVSGSTNCYTGNEWDTSICSDGKSCAQTCCVDGA-D |
| SEQ ID NO: 469 | | RWVHDKNGYTNCYTGNEWNTTICADAASCASNCVVDGA-D |
| SEQ ID NO: 470 | | RWTHQVSGSTNCYTGNKWDTSICTDAKSCAQNCCVDGA-D |
| SEQ ID NO: 471 | | RWTHQVSGSTNCYTGNKWDTSICTDAKSCAQNCCVDGA-D |
| SEQ ID NO: 472 | | LWT-TVDGSQNCYTGNRWDTSICSSEKTCSESCCIDGA-D |
| SEQ ID NO: 473 | | RWAHNVGGYTNCYTGNSWSTQYCPDGDSCTKNCAIDGA-D |
| SEQ ID NO: 474 | | RWLHSTSGYTNCYTGNQWDATLCPDGKTCAANCALDGA-D |
| SEQ ID NO: 475 | | RWLHTVDGYTNCYTGQEWDTSICTDGKTCAEKCALDGA-D |
| SEQ ID NO: 476 | | RWVHTTTGYTNCYTGQTWDASICPDGVTCAKACALDGA-D |
| SEQ ID NO: 477 | | RWVHSTSGYTNCYTGNEWDTSLCPDGKTCAANCALDGA-D |
| SEQ ID NO: 478 | | RWLHTTSGYTNCYTGNSWDATLCPDATTCAQNCAVDGA-D |
| SEQ ID NO: 479 | | RWLHN--NGQNCYEGNKW-TSQCSSATDCAQRCALDGA-N |
| SEQ ID NO: 480 | | RWLHDS-NYQNCYDGNRW-TSACSSATDCAQKCYLEGA-N |
| SEQ ID NO: 481 | | RWLHN--NGQNCYEGNKW-TSQCSSATDCAQRCALDGA-N |
| SEQ ID NO: 482 | | RWIHNIGGYENCYSGNKW-TSVCSTNADCATKCAMEGA-K |
| SEQ ID NO: 483 | | RWLHDD-NMQNCYDGNQW-TNACSTATDCAEKCMIEGAGD |
| SEQ ID NO: 484 | | RWIHSTLGTTSCLTANGWDPTLCPDGITCANYCALDGV-S |
| SEQ ID NO: 485 | | RWTHSTSGSTNCYTGNTWQATLCPDGKTCAANCALDGA-D |

Figure 3a-2

```
SEQ ID NO: 1    78 YASTYGVTTSGNSLSIGFVTQSA-QKNVGARL-YLMAS-D 114
SEQ ID NO: 447    YSSTYGVTTSGNSLTLKFVTQSS-QKNVGSRL-YLMAD-D
SEQ ID NO: 448    YASTYGVTTSGNSLSIGFVTQSA-QKNVGARL-YLMAS-D
SEQ ID NO: 449    YASTYGVTTSGNSLSIGFVTQSA-QKNVGARL-YLMAS-D
SEQ ID NO: 450    YASTYGVTTSADSLSIGFVTQSA-QKNVGARL-YLMAS-D
SEQ ID NO: 451    YASTYGVTTSADSLSIGFVTQSA-QKNVGARL-YLMAS-D
SEQ ID NO: 452    YESTYGVTTDGDSLTLKFVT----GSNVGSRL-YLMDTSD
SEQ ID NO: 453    YEGTYGVTSSGSSLKLNFVT----GSNVGSRL-YLLQD-D
SEQ ID NO: 454    YSGTYGVTTSGNALRLNFVTQSS-GKNIGSRL-YLLQD-D
SEQ ID NO: 455    YSGTYGITTSGNSLRLNFVTGS----NVGSRT-YLMAD-N
SEQ ID NO: 456    YSGTYGVTTSGNALRLNFVTQSS-GKNIGSRL-YLLQD-D
SEQ ID NO: 457    YTGTYGVTASGNSLNLKFVTQGPYSKNIGSRM-YLMES-E
SEQ ID NO: 458    YSGTYGITTSGNSLRLNFVTGS----NVGSRT-YLMAD-N
SEQ ID NO: 459    YEATYGVTTSGSELRLNFVTQGS-SKNIGSRL-YLMSD-D
SEQ ID NO: 460    -RQHLRVTTSGNSLRINFVTTAS-QKNIGSRL-YLLEN-D
SEQ ID NO: 461    YSSTYGITTSGNSLNLKFVTKGQYSTNIGSRT-YLMES-D
SEQ ID NO: 462    YKGTYGVTASGSSLRLNFVTQAS-QKNIGSRL-YLMAD-D
SEQ ID NO: 463    YESTYGVTTSGSSLRLNFVTTAS-QKNIGSRL-YLLAD-D
SEQ ID NO: 464    YASTYGITTSGSSLRLNFVTQSQ-QKNIGSRV-YLMDD-E
SEQ ID NO: 465    YASTYGITTSGSSLRLNFVTQSQ-QKNIGSRV-YLMDD-E
SEQ ID NO: 466    YSSTYGITTSGNALNLKFVTKGQYSTNIGSRT-YLMES-D
SEQ ID NO: 467    YSSTYGITTSGDSLNLKFVTKHQYGTNVGSRV-YLMEN-D
SEQ ID NO: 468    YSSTYGITTSGDSLNLKFVTKHQHGTNVGSRV-YLMEN-D
SEQ ID NO: 469    YQGTYGASTSGNALTLKFVTKGSYATNIGSRM-YLMAS-P
SEQ ID NO: 470    YTSTYGITTNGDSLSLKFVTKGQHSTNVGSRT-YLMDG-E
SEQ ID NO: 471    YTSTYGITTNGDSLSLKFVTKGQYSTNVGSRT-YLMDG-E
SEQ ID NO: 472    YAGTYGVTTTGDALSLKFVQQGPYSKNVGSRL-YLMKD-E
SEQ ID NO: 473    YSGTYGITTSNNALSLKFVTKGSFSSNIGSRT-YLMET-D
SEQ ID NO: 474    YTGTYGITASGSSLKLQFVTG----SNVGSRV-YLMADDT
SEQ ID NO: 475    YESTYGISTSGNALTMNFVTKSS-QTNIGGRV-YLLAADS
SEQ ID NO: 476    YSGTYGITTSGNALTLQFVKG----TNVGSRV-YLLQDAS
SEQ ID NO: 477    YSGTYGITSTGTALTLKFVTG----SNVGSRV-YLMADDT
SEQ ID NO: 478    YSGTYGITTSGNALTLKFKTG----TNVGSRV-YLMQTDT
SEQ ID NO: 479    YQSTYGASTSGDSLTLKFVTKHEYGTNIGSRF-YLMAN-Q
SEQ ID NO: 480    YGSTYGVSTSGDALTLKFVTKHEYGTNIGSRV-YLMNG-S
SEQ ID NO: 481    YQSTYGASTSGDSLTLKFVTKHEYGTNIGSRF-YLMAN-Q
SEQ ID NO: 482    YQETYGVSTSGDALTLKFVQQNSSGKNVGSRM-YLMNG-A
SEQ ID NO: 483    YLGTYGASTSGDALTLKFVTKHEYGTNVGSRF-YLMNG-P
SEQ ID NO: 484    YSSTYGITTSGSALRLQFVTG----TNIGSRV-FLMADDT
SEQ ID NO: 485    YTGTYGVTTSGNSLTLQFVTQS----NVGARLGYLMADDT
```

Figure 3a-3

```
SEQ ID NO: 1    115  T-TYQEFTLLGNEFSFDVDVSQLPCGLNGALYFVSMDADG 153
SEQ ID NO: 447       T-KYQMFTLLNNEFTFDVDVSNLPCGLNGALYFVSMDADG
SEQ ID NO: 448       T-TYQEFTLLGNEFSFDVDVSQLPCGLNGALYFVSMDADG
SEQ ID NO: 449       T-TYQEFTLLGNEFSFDVDVSQLPCGLNGALYFVSMDADG
SEQ ID NO: 450       T-TYQEFTLLGNEFSFDVDVSQLPCGLNGALYFVSMDADG
SEQ ID NO: 451       T-TYQEFTLLGNEFSFDVDVSQLPCGLNGALYFVSMDADG
SEQ ID NO: 452       E-GYQTFNLLDAEFTFDVDVSNLPCGLNGALYFTAMDADG
SEQ ID NO: 453       S-TYQIFKLLNREFSFDVDVSNLPCGLNGALYFVAMDADG
SEQ ID NO: 454       T-TYQIFKLLGQEFTFDVDVSNLPCGLNGALYFVAMDADG
SEQ ID NO: 455       T-HYQIFDLLNQEFTFTVDVSHLPCGLNGALYFVTMDADG
SEQ ID NO: 456       T-TYQIFKLLGQEFTFDVDVSNLPCGLNGALYFVAMDADG
SEQ ID NO: 457       S-KYQGFTLLGQEFTFDVDVSNLGCGLNGALYFVSMDLDG
SEQ ID NO: 458       T-HYQIFDLLNQEFTFTVDVSNLPCGLNGALYFVTMDADG
SEQ ID NO: 459       S-NYELFKLLGQEFTFDVDVSNLPCGLNGALYFVAMDADG
SEQ ID NO: 460       T-TYQKFNLLNQEFTFDVDVSNLPCGLNGALYFVDMDADG
SEQ ID NO: 461       T-KYQMFLLGNEFTFDVDVSNLGCGLNGALYFVSMDADG
SEQ ID NO: 462       S-KYEMFQLLNQEFTFDVDVSNLPCGLNGALYFVAMDEDG
SEQ ID NO: 463       S-TYETFKLFNREFTFDVDVSNLPCGLNGALYFVSMDADG
SEQ ID NO: 464       D-TYTMFYLLNKEFTFDVDVSELPCGLNGAVYFVSMDADG
SEQ ID NO: 465       D-TYTMFYLLNKEFTFDVDVSELPCGLNGAVYFVSMDADG
SEQ ID NO: 466       T-KYQMFKLLGNEFTFDVDVSNLGCGLNGALYFVSMDADG
SEQ ID NO: 467       T-KYQMFELLGNEFTFDVDVSNLGCGLNGALYFVSMDADG
SEQ ID NO: 468       T-KYQMFELLGNEFTFDVDVSNLGCGLNGALYFVSMDADG
SEQ ID NO: 469       T-KYAMFTLLGHEFAFDVDLSKLPCGLNGAVYFVSMDEDG
SEQ ID NO: 470       D-KYQTFELLGNEFTFDVDVSNIGCGLNGALYFVSMDADG
SEQ ID NO: 471       D-KYQTFELLGNEFTFDVDVSNIGCGLNGALYFVSMDADG
SEQ ID NO: 472       S-RYEMFTLLGNEFTFDVDVSKLGCGLNGALYFVSMDEDG
SEQ ID NO: 473       T-KYQMFNLINKEFTFDVDVSKLPCGLNGALYFVEMAADG
SEQ ID NO: 474       --HYQMFQLLNQEFTFDVDMSNLPCGLNGALYLSAMDADG
SEQ ID NO: 475       DDTYELFKLKNQEFTFDVDVSNLPCGLNGALYFSEMDSDG
SEQ ID NO: 476       --NYQMFQLINQEFTFDVDMSNLPCGLNGAVYLSQMDQDG
SEQ ID NO: 477       --HYQLLKLLNQEFTFDVDMSNLPCGLNGALYLSAMDADG
SEQ ID NO: 478       --AYQMFQLLNQEFTFDVDMSNLPCGLNGALYLSQMDQDG
SEQ ID NO: 479       N-KYQMFTLMNNEFAFDVDLSKVECGINSALYFVAMEEDG
SEQ ID NO: 480       D-KYQMFTLMNNEFAFDVDLSKVECGLNSALYFVAMEEDG
SEQ ID NO: 481       N-KYQMFTLMNNEFAFDVDLSKVECGINSALYFVAMEEDG
SEQ ID NO: 482       N-KYQMFTLKNNEFAFDVDLSSVECGMNSALYFVPMKEDG
SEQ ID NO: 483       D-KYQMFNLMGNELAFDVDLSTVECGINSALYFVAMEEDG
SEQ ID NO: 484       --HYRTFQLLNQELAFDVDVSKLPCGLNGALYFVAMDADG
SEQ ID NO: 485       T--YQMFNLLNQEFWFDVDMSNLPCGLNGALYFSAMARTA
```

Figure 3a-4

```
SEQ ID NO: 1    154 GVSKYPTNTAG-------------------AKYGTGYCD 173
SEQ ID NO: 447      GMSKYPTNKAG-------------------AKYGTGYCD
SEQ ID NO: 448      GVSKYPTNTAG-------------------AKYGTGYCD
SEQ ID NO: 449      GVSKYPTNTAG-------------------AKYGTGYCD
SEQ ID NO: 450      GVSKYPTNTAG-------------------AKYGTGYCD
SEQ ID NO: 451      GVTKYPTNTAG-------------------AKYGTGYCD
SEQ ID NO: 452      GVSKYPANKAG-------------------AKYGTGYCD
SEQ ID NO: 453      GVSKYPNNKAG-------------------AKYGTGYCD
SEQ ID NO: 454      GLSKYPGNKAG-------------------AKYGTGYCD
SEQ ID NO: 455      GVSKYPNNKAG-------------------AQYGVGYCD
SEQ ID NO: 456      NLSKYPGNKAG-------------------AKYGTGYCD
SEQ ID NO: 457      GVSKYTTNKAG-------------------AKYGTGYCD
SEQ ID NO: 458      GVSKYPNNKAG-------------------AQYGVGYCD
SEQ ID NO: 459      GTSEYSGNKAG-------------------AKYGTGYCD
SEQ ID NO: 460      GMAKYPTNKAG-------------------AKYGTGYCD
SEQ ID NO: 461      GMSKYSGNKAG-------------------AKYGTGYCD
SEQ ID NO: 462      GMARYPTNKAG-------------------AKYGTGYCD
SEQ ID NO: 463      GVSRFPTNKAG-------------------AKYGTGYCD
SEQ ID NO: 464      GKSRYATNEAG-------------------AKYGTGYCD
SEQ ID NO: 465      GKSRYATNEAG-------------------AKYGTGYCD
SEQ ID NO: 466      GMSKYSGNKAG-------------------AKYGTGYCD
SEQ ID NO: 467      GMSKYSGNKAG-------------------AKYGTGYCD
SEQ ID NO: 468      GMSKYSGNKAG-------------------AKYGTGYCD
SEQ ID NO: 469      GTSKYPSNKAG-------------------AKYGTGYCD
SEQ ID NO: 470      GLSRYPGNKAG-------------------AKYGTGYCD
SEQ ID NO: 471      GLSRYPGNKAG-------------------AKYGTGYCD
SEQ ID NO: 472      GMKRFPMNKAG-------------------AKFGTGYCD
SEQ ID NO: 473      GIGK-GNNKAG-------------------AKYGTGYCD
SEQ ID NO: 474      GMAKYPTNKAG-------------------AKYGTGYCD
SEQ ID NO: 475      GLSKYTTNKAG-------------------AKYGTGYCD
SEQ ID NO: 476      GVSRFPTNTAG-------------------AKYGTGYCD
SEQ ID NO: 477      GMSKYPGNKAG-------------------AKYGTGYCD
SEQ ID NO: 478      GLSKFPTNKAG-------------------AKYGTGYCD
SEQ ID NO: 479      GMASYPSNRAG-------------------AKYGTGYCD
SEQ ID NO: 480      GMRSYSSNKAG-------------------AKYGTGYCD
SEQ ID NO: 481      GMASYPSNRAG-------------------AKYGTGYCD
SEQ ID NO: 482      GMSTEPNNKAG-------------------AKYGTGYCD
SEQ ID NO: 483      GMASYPSNQAG-------------------ARYGTGYCD
SEQ ID NO: 484      GKSKYPGNRAG-------------------AKYGTGYCD
SEQ ID NO: 485      AWMPMVVCASTPLISTRRSTARLLRLPVPPRSRYGRGICD
```

Figure3a-5

```
SEQ ID NO: 1    174 SQCPRDLKFINGQANVEGWEPSSNNANTGIGGHGSCCSEM 213
SEQ ID NO: 447      SQCPRDLKFINGQANVEGWEPSSNDANAGIGNHGSCCAEM
SEQ ID NO: 448      SQCPRDLKFINGQANVEGWEPSSNNANTGIGGHGSCCSEM
SEQ ID NO: 449      SQCPRDLKFINGQANVEGWEPSSNNANTGIGGHGSCCSEM
SEQ ID NO: 450      SQCPRDLKFINGQANVEGWEPSSNNANTGIGGHGSCCSEM
SEQ ID NO: 451      SQCPRDLKFINGQANVEGWEPSSNNANTGIGGHGSCCSEM
SEQ ID NO: 452      SQCPRDLKFIDGQANVDGWEPSSNNDNTGIGNHGSCCPEM
SEQ ID NO: 453      SQCPRDLKFIDGEANVEGWQPSSNNANTGIGDHGSCCAEM
SEQ ID NO: 454      SQCPRDLKFINGQANVEGWQPSANDPNAGVGNHGSCCAEM
SEQ ID NO: 455      SQCPRDLKFIAGQANVEGWTPSANNANTGIGNHGACCAEL
SEQ ID NO: 456      SQCPRDLKFINGQANVEGWQPSANDPNAGVGNHGSSCAEM
SEQ ID NO: 457      SQCPRDLKFINGQANIDGWQPSSNDANAGLGNHGSCCSEM
SEQ ID NO: 458      SQCPRDLKFIAGQANVEGWTPSTNNSNTGIGNHGSCCAEL
SEQ ID NO: 459      SQCPRDLKFINGEANCDGWEPSSNNVNTGVGDHGSCCAEM
SEQ ID NO: 460      SQCPRDLKFINGQANVDGWTPSKNDVNSGIGNHGSCCAEM
SEQ ID NO: 461      SQCPRDLKFINGEANVENWQSSTNDANAGTGKYGSCCSEM
SEQ ID NO: 462      AQCPRDLKFINGQANVEGWEPSSSDVNGGTGNYGSCCAEM
SEQ ID NO: 463      SQCPRDLKFIDGQANIEGWEPSSTDVNAGTGNHGSCCPEM
SEQ ID NO: 464      SQCPRDLKFINGVANVEGWESSDTNPNGGVGNHGSCCAEM
SEQ ID NO: 465      SQCPRDLKFINGVANVEGWESSDTNPNGGVGNHGSCCAEM
SEQ ID NO: 466      AQCPRDLKFINGEANVEGWESSTNDANAGSGKYGSCCTEM
SEQ ID NO: 467      AQCPRDLKFINGEANVGNWTPSTNDANAGFGRYGSCCSEM
SEQ ID NO: 468      AQCPRDLKFINGEANIENWTPSTNDANAGFGRYGSCCSEM
SEQ ID NO: 469      SQCPRDLKFIDGKANSASWQPSSNDQNAGVGGMGSCCAEM
SEQ ID NO: 470      AQCPRDIKFINGEANIEGWTGSTNDPNAGAGRYGTCCSEM
SEQ ID NO: 471      AQCPRDIKFINGEANIEGWTGSTNDPNAGAGRYGTCCSEM
SEQ ID NO: 472      SQCPRDVKFINGMANSKDWIPSKSDANAGIGSLGACCREM
SEQ ID NO: 473      SQCPHDIKFINGKANVEGWNPSDADPNGGAGKIGACCPEM
SEQ ID NO: 474      SQCPRDIKFINGEANVEGWN--ATSANAGTGNYGTCCTEM
SEQ ID NO: 475      TQCPHDIKFINGEANVQNWTASSTDKNAGTGHYGSCCNEM
SEQ ID NO: 476      SQCPRDIKFINGEANVEGWTGSSTDSNSGTGNYGTCCSEM
SEQ ID NO: 477      SQCPKDIKFINGEANVGNWT--ETGSNTGTGSYGTCCSEM
SEQ ID NO: 478      SQCPHDIKFINGMANVAGWAGSASDPNAGSGTLGTCCSEM
SEQ ID NO: 479      AQCARDLKFIGGKANIEGWRPSTNDPNAGVGPMGACCAEI
SEQ ID NO: 480      AQCARDLKFVGGKANIEGWRPSTNDANAGVGPYGACCAEI
SEQ ID NO: 481      AQCARDLKFIGGKANIEGWRPSTNDPNAGVGPMGACCAEI
SEQ ID NO: 482      AQCARDLKFIGGKGNIEGWQPSSTDSSAGIGAQGACCAEI
SEQ ID NO: 483      AQCARDLKFVGGKANIEGWKSSTSDPNAGVGPYGSCCAEI
SEQ ID NO: 484      SQCPRDVQFINGQANVQGWN--ATSATTGTGSYGSCCTEL
SEQ ID NO: 485      SQCPRDIKFINGEANVQGWQPSPNDTNAGTGNYGACCNKM
```

Figure 3a-6

```
SEQ ID NO: 1    214 DIWEANSISEALTPHPCTT---VGQEICEGDCGGTYSD- 249
SEQ ID NO: 447      DIWEANSISTAFTPHPCTT---VGQTRCEGDSCGGTYSS-
SEQ ID NO: 448      DIWEANSISEALTPHPCTT---VGQEICEGDGCGGTYSD-
SEQ ID NO: 449      DIWEANSISEALTPHPCTT---VGQEICEGDGCGGTYSD-
SEQ ID NO: 450      DIWEANSISEALTPHPCTT---VGQEICDGDSCGGTYSG-
SEQ ID NO: 451      DIWEANSISEALTPHPCTT---VGQEICEGDSCGGTYSG-
SEQ ID NO: 452      DIWEANKISTALTPHPCDS---SEQTMCEGNDCGGTYSD-
SEQ ID NO: 453      DVWEANSISNAVTPHPCDT---PGQTMCSGDDCGGTYSN-
SEQ ID NO: 454      DVWEANSISTAVTPHPCDT---PGQTMCQGDDCGGTYSS-
SEQ ID NO: 455      DIWEANSISEALTPHPCDT---PGLSVCTTDACGGTYSS-
SEQ ID NO: 456      DVWEANSISTAVTPHPCDT---PGQTMCQGDDCGGTYSS-
SEQ ID NO: 457      DIWEANKVSAAYTPHPCTT---IGQTMCTGDDCGGTYSS-
SEQ ID NO: 458      DIWEANSISEALTPHPCDT---PGLTVCTADDCGGTYSS-
SEQ ID NO: 459      DVWEANSISNAFTAHPCDS---VSQTMCDGDSCGGTYSAS
SEQ ID NO: 460      DIWEANSISNAVTPHPCDT---PSQTMCTGQRCGGTYST-
SEQ ID NO: 461      DVWEANNMAAAFTPHPCXV---IGQSRCEGDSCGGTYST-
SEQ ID NO: 462      DIWEANSISTAFTPHPCDD---PAQTRCTGDSCGGTYSS-
SEQ ID NO: 463      DIWEANSISSAFTAHPCDS---VQQTMCTGDTCGGTYSDT
SEQ ID NO: 464      DIWEANSISTAFTPHPCDT---PGQTLCTGDSCGGTYSN-
SEQ ID NO: 465      DIWEANSISTAFTPHPCDT---PGQTLCTGDSCGGTYSN-
SEQ ID NO: 466      DVWEANNMATAFTPHPCTT---IGQTRCEGDTCGGTYSS-
SEQ ID NO: 467      DVWEANNMATAFTPHPCTT---VGQSRCEADTCGGTYSS-
SEQ ID NO: 468      DIWDANNMATAFTPHPCTI---IGQSRCEGNSCGGTYSS-
SEQ ID NO: 469      DIWEANSVSAAYTPHPCQN---YQQHSCSGDDCGGTYSA-
SEQ ID NO: 470      DIWEANNMATAFTPHPCTI---IGQSRCEGDSCGGTYSN-
SEQ ID NO: 471      DIWEANNMATAFTPHPCTI---IGQSRCEGDSCGGTYSN-
SEQ ID NO: 472      DIWEANNIASAFTPHPCKN---SAYHSCTGDGCGGTYSK-
SEQ ID NO: 473      DIWEANSISTAYTPHPCRG---VGLQECSDAASCGDGSN-
SEQ ID NO: 474      DIWEANNDAAAYTPHPCT--T-NAQTRCSGSDCT------
SEQ ID NO: 475      DIWEANSQATAFTPHVCEAKV-EGQYRCEGTECGDGD---
SEQ ID NO: 476      DIWEANSVAAAYTPHPCS--V-NQQTRCTGADCGQGD---
SEQ ID NO: 477      DIWEANNDAAAFTPHPCT--T-TGQTRCSGDDCA------
SEQ ID NO: 478      DIWEANNDAAAFTPHPCS--V-DGQTQCSGTQCGDDD---
SEQ ID NO: 479      DVWESNAYAYAFTPHACGS--KNRYHICETNNCGGTYSD-
SEQ ID NO: 480      DVWESNAYAFAFTPHGCLN---NNYHVCETSNCGGTYSE-
SEQ ID NO: 481      DVWESNAYAYAFTPHACGS--KNRYHICETNNCGGTYSD-
SEQ ID NO: 482      DIWESNKNAFAFTPHPCEN---NEYHVCTEPNCGGTYAD-
SEQ ID NO: 483      DVWESNAYAFAFTPHACTT---NEYHVCETTNCGGTYSE-
SEQ ID NO: 484      DIWEANSNAAALTPHTCT--N-NAQTRCSGSNCT------
SEQ ID NO: 485      DVWEANSISTAYTPHPCTQ---RGLVRCSGTACGGGS---
```

Figure 3a-7

```
SEQ ID NO: 1    250 -NRYGGTCDPDGCDWN-PYRLGNT-SFYGPGSSFTLDTTK 286
SEQ ID NO: 447      -DRYAGTCDPDGCDFN-PYRMGNT-TFYGPG---TVDTTK
SEQ ID NO: 448      -NRYGGTCDPDGCDWN-PYRLGNT-SFYGPGSSFTLDTTK
SEQ ID NO: 449      -NRYGGTCDPDGCDWD-PYRLGNT-SFYGPGSSFTLDTTK
SEQ ID NO: 450      -DRYGGTCDPDGCDWN-PYRLGNT-SFYGPGSSFTLDTTK
SEQ ID NO: 451      -DRYGGTCDPDGCDWN-PYRLGNT-SFYGPGSSFTLDTTK
SEQ ID NO: 452      -DRYGGTCDPDGCDFN-PYRMGND-SFYGPGK--TIDTGS
SEQ ID NO: 453      -DRYAGTCDPDGCDFN-PYRMGNT-SFYGPGK--IIDTTK
SEQ ID NO: 454      -TRYAGTCDPDGCDFN-PYRQGNH-SFYGPGQ--IVDTSS
SEQ ID NO: 455      -DRYAGTCDPDGCDFN-PYRLGVT-DFYGSGK--TVDTTK
SEQ ID NO: 456      -TRYAGTCDPDGCDFN-PYQPGNH-SFYGPGK--IVDTSS
SEQ ID NO: 457      -DRYAGICDPDGCDFN-SYRMGDT-SFYGPG--KTVDTGS
SEQ ID NO: 458      -NRYAGTCDPDGCDFN-PYRLGVT-DFYGSGK--TVDTTK
SEQ ID NO: 459     GDRYSGTCDPDGCDYN-PYRLGNT-DFYGPGL--TVDTNS
SEQ ID NO: 460      -DRYGGTCDPDGCDFN-PYRMGVT-NFYGPGE--TIDTKS
SEQ ID NO: 461      -DRYAGICDPDGCDFN-SYRQGNK-TFYGKG--MTVDTTK
SEQ ID NO: 462      -DRYGGTCDPDGCDFN-PYRMGNQ-SFYGPSK--IVDTES
SEQ ID NO: 463     TDRYSGTCDPDGCDFN-PYRFGNT-NFYGPGK--TVDNSK
SEQ ID NO: 464      -DRYGGTCDPDGCDFN-SYRQGNK-TFYGPGL--TVDTNS
SEQ ID NO: 465      -DRYGGTCDPDGCDFN-SYRQGNK-TFYGPGL--TVDTNS
SEQ ID NO: 466      -DRYAGVCDPDGCDFN-SYRQGNK-TFYGKG--MTVDTTK
SEQ ID NO: 467      -DRYAGVCDPDGCDFN-AYRQGDK-TFYGKG--MTVDTNK
SEQ ID NO: 468      -ERYAGVCDPDGCDFN-AYRQGDK-TFYGKG--MTVDTTK
SEQ ID NO: 469      -TRFAGDCDPDGCDWN-AYRMGVH-DFYGNG--KTVDTGK
SEQ ID NO: 470      -ERYAGVCDPDGCDFN-SYRQGNK-TFYGKG--MTVDTTK
SEQ ID NO: 471      -ERYAGVCDPDGCDFN-SYRQGNK-TFYGKG--MTVDTTK
SEQ ID NO: 472      -NRYSGDCDPDGCDFN-SYRLGNT-TFYGPGPKFTIDTTR
SEQ ID NO: 473      --RYDGQCDKDGCDFN-SYRMGVK-DFYGPG--ATLDTTK
SEQ ID NO: 474      --RDTGLCDADGCDFN-SFRMGDQ-TFLG-KG-LTVDTSK
SEQ ID NO: 475      -NRYGGVCDKDGCDFN-SYRMGNE-TFYGSNG-STIDTTK
SEQ ID NO: 476      -DRYDGVCDPDGCDFN-SFRMGDQ-TFLG-KG-LTVDTSR
SEQ ID NO: 477      --RNTGLCDGDGCDFN-SFRMGDK-TFLG-KG-MTVDTSK
SEQ ID NO: 478      -ERYSGLCDKDGCDFN-SFRMGDK-SFLG-KG-MTVDTSR
SEQ ID NO: 479      -DRFAGYCDANGCDYN-PYRMGNK-DFYGKG--KTVDTNR
SEQ ID NO: 480      -DRFGGLCDANGCDYN-PYRMGNK-DFYGKG--KTVDTSR
SEQ ID NO: 481      -DRFAGYCDANGCDYN-PYRMGNK-DFYGKG--KTVDTNR
SEQ ID NO: 482      -DRYGGGCDANGCDYN-PYRMGNP-DFYGPG--KTIDTNR
SEQ ID NO: 483      -DRFAGKCDANGCDYN-PYRMGNP-DFYGKG--KTLDTSR
SEQ ID NO: 484      --SNTGFCDADGCDFN-SFRLGNT-TFLG-AG-MSVDTTK
SEQ ID NO: 485      -NRYGSICDHDGLGFQNLFGMGRTRVRARVGRVKQFNRSS
```

Figure 3a-8

```
SEQ ID NO: 1   287 KLTVVTQFETSG---------AINRYYVQNGVTFQQPNAE 317
SEQ ID NO: 447     KFTVVTQFLTND----GTL-SEIKRFYVQNGKVIPNSEST
SEQ ID NO: 448     KLTVVTQFETSG---------AINRYYVQNGVTFQQPNAE
SEQ ID NO: 449     KLTVVTQFETSG---------AINRYYVQNGVTFQQPNAE
SEQ ID NO: 450     KLTVVTQFETSG---------AINRYYVQNGVTFQQPNAE
SEQ ID NO: 451     KLTVVTQFETSG---------AINRYYVQNGVTFQQPNAE
SEQ ID NO: 452     KMTVVTQFITDG---SGSL-SEIKRYYVQNGNVIANADSN
SEQ ID NO: 453     PFTVVTQFLTDDGTDTGTL-SEIKRFYIQNSNVIPQPNSD
SEQ ID NO: 454     KFTVVTQFITDDGTPSGTL-TEIKRFYVQNGKVIPQSEST
SEQ ID NO: 455     PFTVVTQFVTNDGTSTGSL-SEIRRYYVQNGVVIPQPSSK
SEQ ID NO: 456     KFTVVTQFITDDGTPSGTL-TEIKRFYVQNGKVIPQSEST
SEQ ID NO: 457     KFTVVTQFLTGS---DGNL-SEIKRFYVQNGKVIPNSESK
SEQ ID NO: 458     PFTVVTQFVTDDGTSSGSL-SEIRRYYVQNGVVIPQPSSK
SEQ ID NO: 459     PFTVVTQFITDDGTSSGTL-TEIKRLYVQNGEVIANGAST
SEQ ID NO: 460     PFTVVTQFLTNDGTSTGTL-SEIKRFYVQGGKVIGNPQST
SEQ ID NO: 461     KITVVTQFLKNS---AGEL-SEIKRFYVQNGKVIPNSEST
SEQ ID NO: 462     PFTVVTQFITNDGTSTGTL-SEIKRFYVQNGKVIPQSVST
SEQ ID NO: 463     PFTVVTQFITHDGTDTGTL-TEIRRLYVQNGVVIGNGPST
SEQ ID NO: 464     PVTVVTQFLTDDNTDTGTL-SEIKRFYVQNGVVIPNSEST
SEQ ID NO: 465     PVTVVTQFLTDDNTDTGTL-SEIKRFYVQNGVVIPNSEST
SEQ ID NO: 466     KITVVTQFLKNS---AGEL-SEIKRFYAQDGKVIPNSEST
SEQ ID NO: 467     KMTVVTQFHKNS---AGVL-SEIKRFYVQDGKIIANAESK
SEQ ID NO: 468     KMTVVTQFHKNS---AGVL-SEIKRFYVQDGKIIANAESK
SEQ ID NO: 469     KFSIVTQFKGSG---S-TL-TEIKQFYVQDGRKIENPNAT
SEQ ID NO: 470     KITVVTQFLKDA---NGDL-GEIKRFYVQDGKIIPNSEST
SEQ ID NO: 471     KITVVTQFLKDA---NGDL-GEIKRFYVQDGKIIPNSEST
SEQ ID NO: 472     KISVVTQFLKGR---DGSL-REIKRFYVQNGKVIPNSVSR
SEQ ID NO: 473     KMTVITQFLGSG----SSL-SEIKRFYVQNGKVYKNSQSA
SEQ ID NO: 474     PFTVVTQFITNDGTSAGTL-TEIRRLYVQNGKVIQNSSVK
SEQ ID NO: 475     KFTVVTQFITADNTATGAL-TEIRRKYVQNDVVIENSYAD
SEQ ID NO: 476     KFTIVTQFISDDGTTSGNL-AEIRRFYVQDGNVIPNSKVS
SEQ ID NO: 477     PFTVVTQFLTNDNTSTGTL-SEIRRIYIQNGKVIQNSVAN
SEQ ID NO: 478     KFTVVTQFVTTDGTTNGDL-HEIRRLYVQDGKVIQNSVVS
SEQ ID NO: 479     KFTVVSRFERN---------RLSQFFVQDGRKIEVPPPT
SEQ ID NO: 480     KFTVVTRFEEN---------KLTQFFIQDGRKIDIPPPT
SEQ ID NO: 481     KFTVVSRFERN---------RLSQFFVQDGRKIEVPPPT
SEQ ID NO: 482     KFTVISRFENN---------RNYQILMQDGVAHRIPGPK
SEQ ID NO: 483     KFTVVSRFEEN---------KLSQYFIQDGRKIEIPPPT
SEQ ID NO: 484     TFTVVTQFITSDNTSTGNL-TEIRRFYVQNGNVIPNSVVN
SEQ ID NO: 485     RVVEPISWTKQTTLHLGNLPWKSADCNVQNGRVIQNSKVN
```

Figure 3a-9

```
SEQ ID NO: 1     318 LGSYS--GNELNDDYCTAEEAEFGG-SSFSDKGGLTQFKK 354
SEQ ID NO: 447       IPGVS--GNSITDDFCTAQKTAFGDTNSFADKGGLAQMGK
SEQ ID NO: 448       LGSYS--GNELNDDYCTAEEAEFGG-SSFSDKGGLTQFKK
SEQ ID NO: 449       LGSYS--GNGLNDDYCTAEEAEFGG-SSFSDKGGLTQFKK
SEQ ID NO: 450       LGDYS--GNSLDDDYCAAEEAEFGG-SSFSDKGGLTQFKK
SEQ ID NO: 451       LGDYS--GNSLDDDYCAAEEAEFGG-SSFSDKGGLTQFKK
SEQ ID NO: 452       ISGVT--GNSITTDFCTAQKKAFGDEDIFAEHNGLAGISD
SEQ ID NO: 453       ISGVT--GNSITTEFCTAQKQAFGDTDDFSQHGGLAKMGA
SEQ ID NO: 454       ISGVT--GNSITTEYCTAQKAAFGDNTGFFTHGGLQKISQ
SEQ ID NO: 455       ISGIS--GNVINSDYCAAEISTFGGTASFNKHGGLTNMAA
SEQ ID NO: 456       ISGVT--GNSITTEYCTAQKAAFGDNTGFFTHGGLQKISQ
SEQ ID NO: 457       IAGVS--GNSITTDFCTAQKTAFGDTNVFEERGGLAQMGK
SEQ ID NO: 458       ISGIS--GNVINSDFCAAELSAFGETASFTNHGGLKNMGS
SEQ ID NO: 459       YSSVN--GSSITSAFCESEKTLFGDENVFDKHGGLEGMGE
SEQ ID NO: 460       IVGVS--GNSITDSWCNAQKSAFGDTNEFSKHGGMAGMGA
SEQ ID NO: 461       IPGVE--GNSITQDWCDRQKAAFGDVTDXQDKGGMVQMGK
SEQ ID NO: 462       ISAVT--GNSITDSFCSAQKTAFKDTDVFAKHGGMAGMGA
SEQ ID NO: 463       YTAAS--GNSITESFCKAEKTLFGDTNVFETHGGLSAMGD
SEQ ID NO: 464       YPANP--GNSITTEFCESQKELFGDVDVFSAHGGMAGMGA
SEQ ID NO: 465       YPANP--GNSITTEFCESQKELFGDVDVFSAHGGMAGMGA
SEQ ID NO: 466       IAGIP--GNSITKAYCDAQKTVFQNTDDFTAKGGLVQMGK
SEQ ID NO: 467       IPGNP--GNSITQEYCDAQKVAFSNTDDFNRKGGMAQMSK
SEQ ID NO: 468       IPGNP--GNSITQEWCDAQKVAFGDIDDFNRKGGMAQMSK
SEQ ID NO: 469       WPGLE-PFNSITPDFCKAQKQVFGDPDRFNDMGGFTNMAK
SEQ ID NO: 470       IPGVE--GNSITQDWCDRQKVAFGDIDDFNRKGGMKQMGK
SEQ ID NO: 471       IPGVE--GNSITQDWCDRQKVAFGDIDDFNRKGGMKQMGK
SEQ ID NO: 472       VRGVP--GNSITQGFCNAQKKMFGAHESFNAKGGMKGMSA
SEQ ID NO: 473       VAGVT--GNSITESFCTAQKKAFGDTSSFAALGGLNEMGA
SEQ ID NO: 474       IPGID-PVNSITDNFCSQQKTAFGDTNYFAQHGGLKQVGE
SEQ ID NO: 475       YETLS-KFNSITDDFCAAQKTLSGDTNDFKTKGGIARMGE
SEQ ID NO: 476       IAGID-AVNSITDDFCTQQKTAFGDTNRFAAQGGLKQMGA
SEQ ID NO: 477       IPGVD-PVNSITDNFCAQQKTAFGDTNWFAQKGGLKQMGE
SEQ ID NO: 478       IPGID-AVDSITDNFCAQQKSVFGDTNYFATLGGLKKMGA
SEQ ID NO: 479       WPGLP-NSADITPELCDAQFRVFDDRNRFAETGGFDALNE
SEQ ID NO: 480       WPGLP-NSSAITPELCTNLSKVFDDRDRYEETGGFRTINE
SEQ ID NO: 481       WPGLP-NSADITPELCDAQFRVFDDRNRFAETGGFDALNE
SEQ ID NO: 482       FDGLEGETGELNEQFCTDQFTVFDERNRFNEVGGWSKLNA
SEQ ID NO: 483       WEGMP-NSSEITPELCSTMFDVFNDRNRFEEVGGFEQLNN
SEQ ID NO: 484       VTGIG-AVNSITDPFCSQQKKAFIETNYFAQHGGLAQLGQ
SEQ ID NO: 485       IPGMPSTMDSVTTEFCNAQKTAFNDTFSFQQKGGMANMSE
```

Figure 3a-10

```
SEQ ID NO: 1    355 ATSGGMVLVMSLWDDYYANMLWLDSTYPTNETSSTPGAVR 394
SEQ ID NO: 447      ALAGGMVLVMSLWDDHAANMLWLDSTYPTDADASTPGAAR
SEQ ID NO: 448      ATSGGMVLVMSLWDDYYANMLWLDSTYPTNETSSTPGAVR
SEQ ID NO: 449      ATSGGMVLVMSLWDDYYANMLWLDSTYPTNETSSTPGAVR
SEQ ID NO: 450      ATSGGMVLVMSLWDDYYANMLWLDSTYPTNETSSTPGAVR
SEQ ID NO: 451      ATSGGMVLVMSLWDDYYANMLWLDSTYPTDETSSTPGAVR
SEQ ID NO: 452      AMSS-MVLILSLWDDYYASMEWLDSDYPENATATDPGVAR
SEQ ID NO: 453      AMQQGMVLVMSLWDDYAAQMLWLDSDYPTDADPTTPGIAR
SEQ ID NO: 454      ALAQGMVLVMSLWDDHAANMLWLDSTYPTDADPDTPGVAR
SEQ ID NO: 455      GMEAGMVLVMSLWDDYAVNMLWLDSTYPTNATG-TPGAAR
SEQ ID NO: 456      ALAQGMVLVMSLWDDHAANMLWLDSTYPTDADPDTPGVAR
SEQ ID NO: 457      ALAEPMVLVLSVWDDHAVNMLWLDSTYP-TDST-KPGAAR
SEQ ID NO: 458      ALEAGMVLVMSLWDDYSVNMLWLDSTYPANETG-TPGAAR
SEQ ID NO: 459      AMAKGMVLVLSLWDDYAADMLWLDSDYPVNSSASTPGVAR
SEQ ID NO: 460      GLADGMVLVMSLWDDHASDMLWLDSTYPTNATSTTPGAKR
SEQ ID NO: 461      ALAGPMVLVMSIWDDHAVNMLWLDSTWP-IDGAGKPGAER
SEQ ID NO: 462      GLAEGMVLVMSLWDDHAANMLWLDSTYPTSASSTTPGAAR
SEQ ID NO: 463      ALGDGMVLVLSLWDDHAADMLWLDSDYPTTSCASSPGVAR
SEQ ID NO: 464      ALEQGMVLVLSLWDDNYSNMLWLDSNYPTDADPTQPGIAR
SEQ ID NO: 465      ALEQGMVLVLSLWDDNYSNMLWLDSNYPTDADPTQPGIAR
SEQ ID NO: 466      ALAGDMVLVMSVWDDHAVNMLWLDSTYP-TDQVGVAGAER
SEQ ID NO: 467      ALAGPMVLVMSVWDDHYANMLWLDSTYP-IDQAGAPGAER
SEQ ID NO: 468      ALEGPMVLVMSVWDDHYANMLWLDSTYP-IDKAGTPGAER
SEQ ID NO: 469      ALANPMVLVLSLWDDHYSNMLWLDSTYPTDADPSAPGKGR
SEQ ID NO: 470      ALAGPMVLVMSIWDDHASNMLWLDSTFP-VDAAGKPGAER
SEQ ID NO: 471      ALAGPMVLVMSIWDDHASNMLWLDSTFP-VDAAGKPGAER
SEQ ID NO: 472      AVSKPMVLVMSLWDDHNSNMLWLDSTYP-TNSR-QRGSKR
SEQ ID NO: 473      SLARGHVLIMSLWGDHAVNMLWLDSTYPTDADPSKPGAAR
SEQ ID NO: 474      ALRTGMVLALSIWDDYAANMLWLDSNYPTNKDPSTPGVAR
SEQ ID NO: 475      SFERGMVLVMSVWDDHAANALWLDSSYPTDADASKPGVKR
SEQ ID NO: 476      ALKSGMVLALSLWDDHAANMLWLDSDYPTTADASNPGVAR
SEQ ID NO: 477      ALGNGMVLALSIWDDHAANMLWLDSDYPTKDPSAPGVAR
SEQ ID NO: 478      ALKSGMVLAMSVWDDHAASMQWLDSNYPADGDATKPGVAR
SEQ ID NO: 479      ALTIPMVLVMSIWDDHHSNMLWLDSSYPPEKA-GLPGGDR
SEQ ID NO: 480      ALRIPMVLVMSIWDGHYASMLWLDSVYPPEKA-GQPGAER
SEQ ID NO: 481      ALTIPMVLVMSIWDDHHSNMLWLDSSYPPEKA-GLPGGDR
SEQ ID NO: 482      AYEIPMVLVMSIWSDHFANMLWLDSTYPPEKA-GQPGSAR
SEQ ID NO: 483      ALRVPMVLVMSIWDDHYANMLWLDSIYPPEKE-GQPGAAR
SEQ ID NO: 484      ALRTGMVLAFSISDDPANHMLWLDSNFPPSANPAVPGVAR
SEQ ID NO: 485      ALRRGMVLVLSIWDDHAANMLWLDSITSAAACRSTPSEVH
```

Figure 3a-11

```
SEQ ID NO: 1    395  GSCSTSSGVPAQVESQSPNAKVTFSNIKFGPIGS--TGNP  432
SEQ ID NO: 447       GTCPTTSGVPADVESQSPNAYVVFSNIKFGPIGSTFTGT-
SEQ ID NO: 448       GSCSTSSGVPAQVESQSPNAKVTFSNIKFGPIGS--TGNP
SEQ ID NO: 449       GSCSTSSGVPAQVESQSPNAKVTFSNIKFGPIGS--TGDP
SEQ ID NO: 450       GSCSTSSGVPAQLESNSPNAKVVYSNIKFGPIGS--TGNS
SEQ ID NO: 451       GSSSTSSGVPAQLESNSPNAKVVYSNIKFGPIGS--TGNP
SEQ ID NO: 452       GTCDSESGVPATVEGAHPDSSVTFSNIKFGPINSTFSASA
SEQ ID NO: 453       GTCPTDSGVPSDVESQSPNSYVTYSNIKFGPINSTFTAS-
SEQ ID NO: 454       GTCPTTSGVPADVESQYPNSYVIYSNIKVGPINSTFTAN-
SEQ ID NO: 455       GTCATTSGDPKTVESQSGSSYVTFSDIRVGPFNSTFSGGS
SEQ ID NO: 456       GTCPTTSGVPADVESQNPNSYVIYSNIKVGPINSTFTAN-
SEQ ID NO: 457       GDCPITSGVPADVESQAPNSNVIYSNIRFGPINSTYTGTP
SEQ ID NO: 458       GSCPTTSGNPKTVESQSGSSYVVFSDIKVGPFNSTFSGGT
SEQ ID NO: 459       GTCSTDSGVPATVEAESPNAYVTYSNIKFGPIGSTYSSGS
SEQ ID NO: 460       GTCDISR-RPNTVESTYPNAYVIYSNIKTGPLNSTFTGGT
SEQ ID NO: 461       GACPTTSGVPAEVEAEAPNSNVIFSNIRFGPIGSTVSGLP
SEQ ID NO: 462       GSCDISSGEPSDVEANHSNAYVVYSNIKVGPLGSTF--GS
SEQ ID NO: 463       GTCPTTTGNATYVEANYPNSYVTYSNIKFGTLNSTYSGTS
SEQ ID NO: 464       GTCPTDSGVPSEVEAQYPNAYVVYSNIKFGPIGSTFGNGG
SEQ ID NO: 465       GTCPTDSGVPSEVEAQYPNAYVVYSNIKFGPIGSTFGNGG
SEQ ID NO: 466       GACPTTSGVPSDVEANAPNSNVIFSNIRFGPIGSTVQGLP
SEQ ID NO: 467       GACPTTSGVPAEIEAQVPNSNVIFSNIRFGPIGSTVPGLD
SEQ ID NO: 468       GACPTTSGVPAEIEAQVPNSNVIFSNIRFGPIGSTVPGLD
SEQ ID NO: 469       GTCDTSSGVPSDVESKNGDATVIYSNIKFGPLDSTYTAS-
SEQ ID NO: 470       GACPTTSGVPAEVEAEAPNSNVVFSNIRFGPIGSTVAGLP
SEQ ID NO: 471       GACPTTSGVPAEVEAEAPNSNVVFSNIRFGPIGSTVAGLP
SEQ ID NO: 472       GSCPASSGRPTDVESSAPDSTVVFSNIKFGPIGSTFS---
SEQ ID NO: 473       GTCPTTSGKPEDVEKNSPDATVVFSNIKFGPIGSTFAQPA
SEQ ID NO: 474       GTCATTSGVPAQIEAQSPNAYVVFSNIKFGDLNTTYTGTV
SEQ ID NO: 475       GPCSTSSGVPSDVEANDADSSVIYSNIRYGDIGSTFNKTA
SEQ ID NO: 476       GTCPTTSGFPRDVESQSGSATVTYSNIKWGDLNSTFTGTL
SEQ ID NO: 477       GTCATTSGVPSDVESQVPNSQVVFSNIKFGDIGSTFSGTS
SEQ ID NO: 478       GTCSADSGLPTNVESQSASASVTFSNIKWGDINTTFTGT-
SEQ ID NO: 479       GPCPTTSGVPAEVEAQYPNAQVVWSNIRFGPIGSTVNV--
SEQ ID NO: 480       GPCAPTSGVPAEVEAQFPNAQVIWSNIRFGPIGSTYQV--
SEQ ID NO: 481       GPCPTTSGVPAEVEAQYPDAQVVWSNIRFGPIGSTVNV--
SEQ ID NO: 482       GPCPADGGDPNGVVNQYPNAKVIWSNVRFGPIGSTYQVD-
SEQ ID NO: 483       GDCPTDSGVPAEVEAQFPDAQVVWSNIRFGPIGSTYDF--
SEQ ID NO: 484       GMCSITSGNPADVGILNPSPYVSFLNIKFGSIGTTFRPA-
SEQ ID NO: 485       ATPLRESQIRSSHSRQTR--YVTFTNIKFGPFNSTGTTYT
```

Figure 3a-12

```
SEQ ID NO: 1      433 SGGN 436
SEQ ID NO: 447        --G-
SEQ ID NO: 448        SGGN
SEQ ID NO: 449        SGGN
SEQ ID NO: 450        SGGN
SEQ ID NO: 451        SGGN
SEQ ID NO: 452        ----
SEQ ID NO: 453        ----
SEQ ID NO: 454        ----
SEQ ID NO: 455        STGG
SEQ ID NO: 456        ----
SEQ ID NO: 457        SGGN
SEQ ID NO: 458        STGG
SEQ ID NO: 459        SSGS
SEQ ID NO: 460        TSSS
SEQ ID NO: 461        DGG-
SEQ ID NO: 462        TDSG
SEQ ID NO: 463        SGGS
SEQ ID NO: 464        GSGP
SEQ ID NO: 465        GSGP
SEQ ID NO: 466        SSGG
SEQ ID NO: 467        GSNP
SEQ ID NO: 468        GSTP
SEQ ID NO: 469        ----
SEQ ID NO: 470        GAGN
SEQ ID NO: 471        GAGN
SEQ ID NO: 472        -RGK
SEQ ID NO: 473        ----
SEQ ID NO: 474        ----
SEQ ID NO: 475        ----
SEQ ID NO: 476        TTPS
SEQ ID NO: 477        ----
SEQ ID NO: 478        ----
SEQ ID NO: 479        ----
SEQ ID NO: 480        ----
SEQ ID NO: 481        ----
SEQ ID NO: 482        ----
SEQ ID NO: 483        ----
SEQ ID NO: 484        ----
SEQ ID NO: 485        TGSV
```

Figure 3a-13

```
TrCel7A (SEQ ID NO: 1)   1   QSACTLQSETHPPLTWQKCSSGGTCTQQTGSVVIDANWRW   40
MtCel7A (SEQ ID NO: 2)   1   QNACTLTAENHPSLTWSKCTSGGSCTSVQGSITIDANWRW   40

TrCel7A (SEQ ID NO: 1)  41   THATNSSTNCYDGNTWSSTLCPDNETCAKNCCLDGAAYAS   80
MtCel7A (SEQ ID NO: 2)  41   THRTDSATNCYEGNKWDTSYCSDGPSCASKCCIDGADYSS   80

TrCel7A (SEQ ID NO: 1)  81   TYGVTTSGNSLSIGFVTQ-SAQKNVGARLYLMASDTTYQE  119
MtCel7A (SEQ ID NO: 2)  81   TYGITTSGNSLNLKFVTKGQYSTNIGSRTYLMESDTKYQM  120

TrCel7A (SEQ ID NO: 1) 120   FTLLGNEFSFDVDVSQLPCGLNGALYFVSMDADGGVSKYP  159
MtCel7A (SEQ ID NO: 2) 121   FQLLGNEFTFDVDVSNLGCGLNGALYFVSMDADGGMSKYS  160

TrCel7A (SEQ ID NO: 1) 160   TNTAGAKYGTGYCDSQCPRDLKFINGQANVEGWEPSSNNA  199
MtCel7A (SEQ ID NO: 2) 161   GNKAGAKYGTGYCDSQCPRDLKFINGEANVENWQSSTNDA  200
                                           *         *
TrCel7A (SEQ ID NO: 1) 200   NTGIGGHGSCCSEMDIWEANSISEALTPHPCTTVGQEICE  239
MtCel7A (SEQ ID NO: 2) 201   NAGTGKYGSCCSEMDVWEANNMAAAFTPHPCTVIGQSRCE  240

TrCel7A (SEQ ID NO: 1) 240   GDGCGGTYSDNRYGGTCDPDGCDWNPYRLGNTSFYGPGSS  279
MtCel7A (SEQ ID NO: 2) 241   GDSCGGTYSTDRYAGICDPDGCDFNSYRQGNKTFYGKG--  278

TrCel7A (SEQ ID NO: 1) 280   FTLDTTKKLTVVTQFETSGA-----INRYYVQNGVTFQQP  314
MtCel7A (SEQ ID NO: 2) 279   MTVDTTKKITVVTQFLKNSAGELSEIKRFYVQNGKVIPNS  318

TrCel7A (SEQ ID NO: 1) 315   NAELGSYSGNELNDDYCTAEEAEFGGSS-FSDKGGLTQFK  353
MtCel7A (SEQ ID NO: 2) 319   ESTIPGVEGNSITQDWCDRQKAAFGDVTDFQDKGGMVQMG  358

TrCel7A (SEQ ID NO: 1) 354   KATSGGMVLVMSLWDDYYANMLWLDSTYPTNETSSTPGAV  393
MtCel7A (SEQ ID NO: 2) 359   KALAGPMVLVMSIWDDHAVNMLWLDSTWPIDG-AGKPGAE  397

TrCel7A (SEQ ID NO: 1) 394   RGSCSTSSGVPAQVESQSPNAKVTFSNIKFGPIGSTGN--  431
MtCel7A (SEQ ID NO: 2) 398   RGACPTTSGVPAEVEAEAPNSNVIFSNIRFGPIGSTVSGL  437

TrCel7A (SEQ ID NO: 1) 432   PSGGNPPGGNPPGTTTTRRPATTTGSS--PGPT-----QS  464
MtCel7A (SEQ ID NO: 2) 438   PDGGSG-NPNPPVSSSTPVPSSSTTSSGSSGPTGGTGVAK  476

TrCel7A (SEQ ID NO: 1) 465   HYGQCGGIGYSGPTVCASGTTCQVLNPYYSQCL  497
MtCel7A (SEQ ID NO: 2) 477   HYEQCGGIGFTGPTQCESPYTCTKLNDWYSQCL  509
```

FIGURE 4

```
SEQ ID NO: 1    463 -QSHYGQCGGIGYSGPTVCASGTTCQVLNPYYSQCL 497
SEQ ID NO: 2    474 VAKHYEQCGGIGFTGPTQCESPYTCTKLNDWYSQCL 509
SEQ ID NO: 486     TQSHYGQCGGIGYSGPTVCASGTTCQVLNPYYSQCL
SEQ ID NO: 487     TQSHYGQCGGIGYSGPTVCASGTTCQVLNPYYSQCL
SEQ ID NO: 488     TQTHYGQCGGIGYSGPTVCASGSTCQVLNPYYSQCL
SEQ ID NO: 489     TQTHYGQCGGIGYIGPTVCASGSTCQVLNPYYSQCL
SEQ ID NO: 490     VAAHWGQCGGQGWTGPTTCASGTTCTVVNPYYSQCL
SEQ ID NO: 491     TVPQ-GQCGGIGYTGPTTCASPTTCHVLNPYYSQCY
SEQ ID NO: 492     VAGHWGQCGGQGWTGPTTCVSGTTCTVVNPYYSQCL
SEQ ID NO: 493     TVPQWGQCGGIGYTGSTTCASPYTCHVLNPYYSQCY
SEQ ID NO: 494     VAQLYGQCGGQGWTGPTTCASG-TCTKQNDYYSQCL
SEQ ID NO: 495     TTQKWGQCGGIGYTGCTNCVAGTTCTQLNPWYSQCL
SEQ ID NO: 496     TTQKWGQCGGIGYTGCTNCVAGTTCTELNPWYSQCL
SEQ ID NO: 497     TVAQWGQCGGTGFTGPTVCASPFTCHVVNPYYSQCY
SEQ ID NO: 498     QQTHWGQCGGQGWTGPTVCQSPYTCKYSNDWYSQCL
SEQ ID NO: 499     AAQAYGQCGGQGWTGPTTCVSGYTCTYENAYYSQCL
SEQ ID NO: 500     VAKHYEQCGGIGFTGPTQCESPYTCTKLNDWYSQCL
SEQ ID NO: 501     QAQHWEQCGGNGWTGPTVCASPWACTVVNSWYSQCL
SEQ ID NO: 502     QAQHWEQCGGNGWTGPTVCASPWACTVVNSWYSQCL
SEQ ID NO: 503     TVAQWAQCGGIGYSGATTCVSPYTCHVVNAYYSQCY
SEQ ID NO: 504     GAAHYAQCGGQNWTGPTTCASPYTCQRQGDYYSQCL
SEQ ID NO: 505     TVPQWGQCGGIGYSGSTTCASPYTCHVLNPCESILS
SEQ ID NO: 506     KAGRWQQCGGIGFTGPTQCEEPYTCTKLNDWYSQCL
SEQ ID NO: 507     TAKHWQQCGGNGWTGPTVCESPYKCTKQNDWYSQCL
SEQ ID NO: 508     KAGRWQQCGGIGFTGPTQCEEPYICTKLNDWYSQCL
SEQ ID NO: 509     GARDWAQCGGNGWTGPTTCVSPYTCTKQNDWYSQCL
```

FIGURE 5

CELLOBIOHYDROLASE ENZYMES

The instant application claims benefit of U.S. Provisional Application No. 61/529,333 filed Aug. 31, 2011.

FIELD OF THE INVENTION

The present invention relates to isolated cellobiohydrolase enzymes. More specifically, the invention relates to isolated cellobiohydrolase enzymes of Glycosyl Hydrolase Family 7. The present invention also relates to genetic constructs comprising nucleotide sequences encoding for isolated cellobiohydrolase enzymes, methods for the production of the isolated cellobiohydrolase enzymes from host strains and the use of the isolated cellobiohydrolase enzymes in the hydrolysis of cellulose.

BACKGROUND OF THE INVENTION

Lignocellulosic feedstocks are a promising alternative to corn starch for the production of fuel ethanol. These raw materials are widely available, inexpensive and several studies have concluded that cellulosic ethanol generates close to zero greenhouse gas emissions.

However, these feedstocks are not easily broken down into their composite sugar molecules. Recalcitrance of lignocellulose can be partially overcome by physical and/or chemical pretreatment. An example of a chemical pretreatment is steam explosion in the presence of dilute sulfuric acid (U.S. Pat. No. 4,461,648). This process removes most of the hemicellulose, but there is little conversion of the cellulose to glucose. The pretreated material may then be hydrolyzed by cellulase enzymes.

The term cellulase broadly refers to enzymes that catalyze the hydrolysis of the beta-1,4-glucosidic bonds joining individual glucose units in the cellulose polymer. Cellulases belong to the larger group of glycosyl hydrolases (GHs) which are organized in families and clans based on structural homology (Davies and Henrissat, 1995, *Structure* 15:853; Carbohydrate Active Enzymes database, Cantarel et al., 2009, *Nucleic Acids Res.*, 37:D233). An updated database of members of the over 100 families of GH enzymes may be found at URL: www.cazy.org/Glycoside-Hydrolases/html. GHs include enzymes that catalyze the hydrolysis of other oligo- and poly-saccharides (e.g. glucanases, xylanases, mannosidases, galactosidases, etc.).

The conversion of cellulose to glucose involves the synergistic actions of endoglucanases (E.C. 3.2.1.4), cellobiohydrolases (E.C. 3.2.1.91) and beta-glucosidases (E.C. 3.2.1.21) (Henrissat et al, 1994; Knowles et al., 1987; Lynd et al., 2002; Teeri, 1997; Wood and Garcia-Campayo, 1990; Zhang and Lynd, 2004). Endoglucanases hydrolyze accessible glycosidic bonds in the middle of the cellulose chain, while cellobiohydrolases processively release cellobiose from these chain ends. Beta-glucosidases hydrolyze cellobiose to glucose thus minimizing product inhibition of the cellobiohydrolases and endoglucanases.

Although cellulases drive hydrolysis of cellulose to glucose, additional enzymes have been discovered that enhance the efficiency of a cellulase system. These enzymes may include hemicellulases, which break down xylan and other hemicellulosic material in biomass (Maheshwari et al., 2000, *Microbiol Mol Biol Rev.* 64:461); swollenins and expansins, which rearrange the structure of cellulose (Saloheimo et al, 2002, *Eur. J. Biochem.* 269:4202; Sampedro and Cosgrove, 2005, *Genome Biol.* 6:242); and partially or uncharacterized activities such as the GH Family 61 enzymes (Harris et al., 2010, *Biochemistry* 49:3305) and the cellulose-induced proteins (CIPs—Foreman et al., 2003, *J. Biol. Chem.* 278:31988). High efficiency cellulase systems for the conversion of lignocellulosic substrates will incorporate any or all of these enzymes depending on the composition of the biomass and the process conditions (Henrissat et al., 1985, *Bio/technology* 3:722; Baker et al., 1998, *Appl. Biochem. Biotechnol.* 70-72:395; Boisset et al., 2001, *Biotechnol. Bioeng.* 72:339; Berlin et al., 2007, *Biotechnol. Bioeng.* 97:287; Gusakov et al., 2007, *Biotechnol. Bioeng.* 97:1028; WO2008/025165; WO2009/026722; Meyer et al., 2009, *J. Cereal Sci.* 50:337).

Cellulases—as well as other GH enzymes—share common gross structures and mechanisms of catalysis (Teeri et al., 1992, *Biotechnology* 21:417). All GH enzymes have a catalytic domain (CD) and the particular structure of this domain determines its GH Family designation, of which there are over 100. Two general catalytic mechanisms have been identified for GHs and all enzymes from a given family will have a common mechanism (McCarter and Withers, 1994, *Curr. Opin. Struct. Biol.* 4:885; Zechel and Withers, 2000, *Acc. Chem. Res.* 33:11). Retaining enzymes, which retain the anomeric configuration of the reducing end, hydrolyze by means of a double displacement reaction wherein the reducing side of the target linkage is first displaced and covalently attached to an acidic residue in the active site, followed by a second displacement, usually by water (though possibly by other hydroxyl-containing compounds including sugars) to complete the displacement (White and Rose, 1997, *Curr. Op. Struct. Biol.* 7:645). Inverting enzymes, which invert the configuration of the anomeric carbon, have an activated water to which the reducing end of the target linkage is directly displaced.

Cellulases, as well as many hemicellulases and enzymes accessory to cellulose hydrolysis, often have a carbohydrate binding module (CBM) also referred to as a cellulose binding domain (CBD) in the case of cellulases. One function of the CBM is to facilitate contact of the CD with the substrate. Some research suggests that certain CBMs may also disrupt cellulose structure and thus facilitate catalytic activity by the CD (Din et al., 1994, *Proc. Natl. Acad. Sci. U.S.A.* 91:11383; Teeri et al., 1992, *Biotechnology* 21:417). There are three general types of CBM represented in over 40 different families. Of these, Type I CBMs bind to the surface of crystalline cellulose; Family 1 CBMs belong to Type I and are the only type found in glycosyl hydrolases from filamentous fungi. Structurally, a CBM/CBD may be nearly contiguous with the CD, but usually these domains are connected by an unstructured, often glycosylated, linker peptide typically of 10 to 50 residues in length that may be involved in cellulose interactions (Srisodsuk et al., 1993, *J. Biol. Chem.* 268:20756).

The cellobiohydrolases are the primary drivers of cellulose hydrolysis. These enzymes bind to the free ends of cellulose chains and catalyze, often processively, the cleavage of cellobiose units from the chain ends. Thus, cellobiohydrolases catalyze the majority of reactions that release soluble oligosaccharides from the solid cellulose substrate and make them available for further hydrolysis to glucose. There are two major classes of CBH (Barr et al., 1996, *Biochemistry* 35:586). Cellobiohydrolase 2 (CBH2 or CBHII) enzymes are inverting enzymes that hydrolyze from the non-reducing end of the cellulose chain; most CBH2 enzymes are found in GH Family 6. Cellobiohydrolase 1 (CBH1 or CBHI) enzymes are retaining enzymes that hydrolyze from the reducing end of the cellulose chain; most CBH1 enzymes are found in GH Family 7. CBH-like enzyme activities exist in other GH Families (e.g. Family 9 and 48). The activities of, and synergy between, CBH1 and CBH2 accounts for a majority of total cellulase activity from most fungal systems.

Glycoside hydrolase enzymes comprising Family 7 CDs are found in eukaryotes, primarily fungi, and comprise both exo- and endo-glucanases. GH Family 7 enzymes are mostly cellulases, although chitosanase and xylanase activities have also been reported. The family is distinguished by a beta-jelly roll core structure, with much of the protein in random coil held together by disulfide bonds. Exoglucanases of this family, in contrast to endoglucanases, have peptide loops that cover the active site cleft, turning it into a closed tunnel that channels a cellulose chain past the active site residues and enables high processivity (Kleywegt et al., 1997, *J Mol Biol.* 272:383). The active site tunnel or cleft consists of a series of monomer (glucose in the case of cellulose) binding sites that associate with the polysaccharide chain by means of ring stacking interactions between the sugar residues and aromatic side chains in the cleft. In the case of cellulases, the bound cellulose is thus correctly aligned with two acidic residues at the active site which catalyze the double displacement hydrolysis. The monomer binding sites are numbered from the point of catalysis, with positive numbers proceeding in the direction of the reducing end of the cellulose chain, and negative numbers in the direction of the non-reducing end. Therefore, the catalytic site lies between +1 and −1 sites, and for the Cel7 cellobiohydrolases, the product binding site would be the +1 and +2 sites which would be occupied by cellobiose after the initial displacement (Divne et al., 1998, *J. Mol. Biol.* 275:309).

Cellulases and other GHs are produced by a wide range of organisms for a variety of natural purposes. Cellulases are predominantly enzymes secreted by micro-organisms—bacteria and fungi—to obtain nutrients from the environment. Bacteria often secret enzymes that are linked together in an extended, non-covalently associated structure called the cellulosome (Fontes and Gilbert, 2010, *Annu Rev Biochem.* 79:655). Fungi typically express individual enzymes, though some fungi, such as those living in the rumen of ruminant animals (e.g. sheep and cattle), can also form extended cellulosome-like structures (Ljungdahl, 2008, *Ann. N.Y. Acad. Sci.* 1125:308). The precise enzymes and enzyme ratios that an organism expresses will be determined by the substrates upon which they have evolved and the current substrate upon which they are growing. Expression of most cellulases and hemicellulases is induced by small molecules related to the target substrate (Schmoll and Kubicek, 2003, *Acta Microbiol Immunol Hung.* 50:125; Mach and Zeilinger, 2003, *Appl Microbiol Biotechnol.* 60:515).

The mesophilic fungus *Trichoderma reesei* (the anamorph of *Hypocrea jecorina*) and the thermophilic fungus *Myceliophthora thermophila* (the anamorph of *Thielavia heterothallica*) are major sources for industrially useful glycoside hydrolases. Both secrete large amounts of protein comprised mostly of hydrolytic enzymes, and for this reason are useful production hosts for industrial enzymes.

*T. reesei* secretes two GH Family 7 enzymes, CBH1 (Cel7A) and EG1 (Cel7B), of which the Cel7A is the major secreted protein product. The three-dimensional structures of the catalytic domains of both Cel7A and Cel7B have been solved (Divne, et al., 1998, *J. Mol. Biol.* 275: 309-325; Kleywegt et al., 1997, *J. Biol. Chem.* 272: 383-397) as have structures for several other Family 7 enzymes. *M. thermophila* secretes at least three GH Family 7 enzymes. Other industrially relevant cellulases come from fungi including, but are not limited to, species of *Aspergillus, Chaetomium, Chrysosporium, Coprinus, Corynascus, Fomitopsis, Fusarium, Humicola, Magnaporthe, Melanocarpus, Myceliophthora, Neurospora, Phanerochaete, Podospora, Rhizomucor, Sporotrichum, Talaromyces, Thermoascus, Thermomyces* and *Thielavia*.

GHs, particularly cellulases and hemicellulases, have many useful applications in industry. Cellulases are used in the textile industry for biopolishing, denim abrasion, and detergent applications (e.g. Anish et al., 2007, *Biotechnol Bioeng.* 96:48; Montazer et al., 2010, *Appl Biochem Biotechnol.* 160:2114; Shimonaka et al., 2006, *Biosci Biotechnol Biochem.* 70:1013). Glucanases and xylanases are used in the brewing and baking industries to reduce viscosity and improve product texture (e.g. Bai et al., 2010, *Appl Microbiol Biotechnol.* 87:251). Hemicellulases, particularly xylanases, are used in the pulp and paper industry to improve bleachability, improve process efficiency and modify paper quality and attributes (e.g. Suurnäkki et al., 1997, *Adv Biochem Eng Biotechnol.* 57:261). Finally, cellulases are being used to hydrolyze cellulose to sugars for fermentation to value added products, particularly biofuels and fuel grade ethanol (Dashtban et al., 2009, *Int J Biol Sci.* 5:578). Because GH Family 7 cellobiohydrolases are recognized as primary drivers of cellulose hydrolysis in cellulase enzyme systems, intense efforts have been made to improve these enzymes using the methods of modern molecular biology.

Targets for enzyme improvement depend upon the process conditions and the end goal of the enzyme application. Common improvement targets are thermostability and thermophilicity to enable enzymes to work at high process temperatures. Higher process temperatures are favored to increase reaction rates and decrease the likelihood of microbial contamination. Another common target is pH optimum and range, which may need to be aligned between enzyme and process. Reducing enzyme inhibition and inactivation by process-specific factors, including product inhibition, may be important for certain process configurations. Finally, increasing the specific activity of an enzyme under process conditions is always desirable. Targets for enzyme modification are far ranging and highly specific to the process and end goal. One general target may be broadening, narrowing, or changing the substrate specificity. Another general target might be limiting the stereochemistry of a reaction.

Many approaches have been developed to improve and/or modify the attributes of an enzyme. These run a gamut from rational design to directed evolution. For rational design, the structure/function relationship of the protein is carefully considered and conscious design changes are made based on an understanding of protein biochemistry (e.g. Wohlfahrt et al., 2003, *Biochemistry* 42:10095). For directed evolution, a library of enzyme variants comprising random changes throughout the amino acid sequence is made and the library is screened by means of an assay to identify improved/altered variants (Arnold and Moore, 1997, *Adv Biochem Eng Biotechnol.* 58:1; Kim et al., 2000, *Appl Environ Microbiol.* 66:788). A great many hybrid approaches also exist, sometimes referred to as "semi-rational" design. For example, it has been known for a long time that the consensus sequence of a protein family is often more stable than individual members (Lehmann et al., 2000, *Biochim Biophys Acta.* 1543:408; Lehmann and Wyss, 2001, *Curr Opin Biotechnol.* 12:371). Therefore, one approach to generating more stable enzymes is to mutate non-consensus residues to the consensus sequence. Another example is the SCHEMA approach involves the random swapping of structurally defined domains from several members of a common protein family and then screening for improved/altered variants by means of an assay (Silberg et al., 2004, *Methods Enzymol.* 388:35; Heinzelman et al., 2009, *Proc Natl Acad Sci USA.* 106:5610).

A third example is the ProSar algorithm which uses information from initial random screens to design secondary and tertiary recombinants for screening (Fox et al., 2003, *Protein Eng.* 16:589).

GH Family 7 enzymes have been an area of intense investigation and development for commercial applications. For example, the *Trichoderma* Cel7A has been mutated by rational design to alter the pH optimum and thermostability of the enzyme (Becker et al., 2001, *Biochem J.* 356:19; Boer and Koivula, 2003, *Eur J Biochem.* 270:841). A Cel7A consensus sequence has been constructed and expressed, and shown to be more thermostable than the *Trichoderma* Cel7A enzyme (U.S. Publication No. 2005/0054039). The SCHEMA approach has been applied to create hybrid Cel7A enzymes of increased thermostability (Heinzelman et al., 2010, *Protein Eng Des Sel.* 23:871). Random mutagenesis has also been applied to identify improved *Trichoderma* Cel7A variants. Both rational design and directed evolution have been applied to improve the thermostability of Cel7B from *Melanocarpus* (Voutilainen et al., 2007, *Enz Microb Technol.* 41:234; Voutilainen et al., 2009, *Appl Microbiol Biotechnol.* 83:261). A similar rational design approach was applied to stabilize Cel7A from *Talaromyces*, and serendipitously improved the specific activity in one instance (Voutilainen et al., 2010, *Protein Eng Des Sel.* 23:69). The CBM of the *Trichoderma* Cel7A has been engineered to make binding to cellulose pH-sensitive and thus reversible under process conditions, enabling the possibility of enzyme recycling (Reinikainen et al., 1992, *Proteins* 14:475; Reinikainen et al., 1995, *Proteins* 22:392; Linder et al., 1999, *FEBS Lett.* 447:13). The $K_M$ of the *Humicola* Cel7 endoglucanase was lowered by rational design mutations that create an additional sugar monomer binding site (Davies et al., 1997, *J Biotechnol.* 57:91).

Well-designed assays are key to the successful identification of improved enzymes, particularly in the case of stochastic methods (e.g. directed evolution). Although soluble chromogenic and fluorogenic substrates have been developed for detecting the activity of GH enzymes and may be used in some screening assays, the performance of a GH enzyme on these artificial substrates often does not correlate to activity on a native or technical substrate such as cellulose or xylan. Instances where improvement on one substrate did not correlate to improvement on another have been documented (Teeri et al., 1998, *Biochem Soc Trans.* 26:173; Voutilainen et al., 2010, *Protein Eng Des Sel.* 23:69; Kurašin and Väljamäe, 2011, *J Biol Chem.* 286:169). Therefore, when screening for improved enzymes, it is critical to use process relevant substrates and conditions.

Variants of *T. reesei* (*H. jecorina*) Cel7A comprising a number of amino acid substitutions are disclosed in U.S. Pat. No. 7,951,570, U.S. Publication No. 2011/0229956, and U.S. Publication No. 2009/0075336. Variants of *M. thermophile* CBH1a comprising a number of amino acid substitutions are disclosed in U.S. Publication No. 2012/0003703. However, these variants were isolated by screening for improved thermostability or thermophilicity using soluble substrates rather than a cellulosic substrate. In some cases, the thermostable variants were subsequently characterized for their cellulose-hydrolyzing activity.

Here we present variants of *T. reesei* Cel7A isolated by screening for improved activity using process-relevant substrates under process-relevant conditions. Specific mutations conferring improvement were mapped to Cel7A cellobiohydrolases from other organisms to demonstrate that the improvements can be generalized to GH Family 7 enzymes.

SUMMARY OF THE INVENTION

The present invention relates to isolated cellobiohydrolase enzymes. More specifically, the invention relates to isolated cellobiohydrolase enzymes of Glycosyl Hydrolase Family 7 with increased activity, reduced product inhibition or improved stability. Cellobiohydrolase enzymes of the present invention find utility in industrial processes requiring efficient conversion of cellobiose to glucose, particularly under conditions of high substrate concentrations or for the hydrolysis of lignocellulosic biomass.

In a first aspect, the invention relates to an isolated cellobiohydrolase enzyme comprising a modified Family 7 catalytic domain with one or more amino acid substitution at position 26, 39, 45, 46, 51, 52, 53, 54, 75, 87, 93, 95, 102, 111, 114, 129, 130, 131, 138, 139, 143, 144, 150, 155, 156, 181, 183, 184, 197, 209, 211, 219, 237, 241, 253, 260, 264, 271, 282, 314, 316, 324, 326, 339, 343, 351, 353, 358, 364, 368, 370, 373, 374, 375, 378, 379, 382, 383, 385, 390, 398, 400, 406, 419, 420, 423, 435, 436, or any combination thereof. The positions are determined from alignment of a parental Family 7 cellulase with SEQ ID NO: 1. The modified Family 7 catalytic domain comprises an amino acid sequence that exhibits from about 45% to about 99.9% sequence identity to amino acid 1-436 of SEQ ID NO: 1 or to amino acids 1-438 of SEQ ID NO: 2.

Such isolated cellobiohydrolase enzymes comprising a modified Family 7 catalytic domain as described above exhibit increased specific activity, reduced inhibition by glucose, reduced inactivation by lignin, increased activity in the presence of lignin, increased activity in the presence of lignocellulose hydrolysate, or any combination thereof, relative to a cellobiohydrolase comprising a parental Family 7 catalytic domain from which the modified Family 7 catalytic domain is derived.

In one embodiment, the modified Family 7 catalytic domain comprises one or more amino acid substitution at position 26, 39, 45, 46, 52, 53, 54, 87, 95, 102, 129, 130, 139, 143, 144, 183, 184, 197, 237, 241, 253, 264, 271, 282, 314, 316, 324, 326, 339, 343, 364, 368, 379, 382, 385, 390, 398, 406, 423, or any combination thereof.

In another embodiment, the modified Family 7 catalytic domain comprises one or more amino acid substitution selected from the group consisting of: X26A, X45D, X46A, X46L, X46T, X51I, X52R, X52W, X53A, X53M, X53R, X53W, X54S, X54I, X54D, X75S, X87T, X93V, X95L, X95Y, X102R, X111T, X129S, X130N, X130E, X138S, X139E, X139M, X139Q, X139S, X139R, X143L, X143G, X144A, X144V, X150N, X181L, X183N, X184S, X197L, X197V, X197Q, X197W, X219S, X237T, X241L, X241R, X241V, X253R, X260D, X264C, X264Y, X271I, X326F, X343L, X351R, X353M, X364V, X368A, X373Y, X374V, X375A, X378E, X379C, X379E, X382L, X382Q, X382I, X383S, X385I, X385L, X390A, X390G, X390K, X390W, X390C, X390L, X390V, X400G, X406P, X419F, and X436D, and exhibits from about 65% to about 99.9% identical to amino acids 1-436 of SEQ ID NO: 1 or to amino acids 1-438 of SEQ ID NO: 2.

For example, the modified Family 7 catalytic domain may comprise one or more amino acid substitution selected from the group consisting of: X45D, X46A, X46L, X46T, X52R, X53A, X53M, X53R, X53W, X54S, X54I, X54D, X87T, X95L, X95Y, X102R, X129S, X130N, X139M, X139S, X139R, X143L, X143G, X144V, X183N, X184S, X197L, X197V, X197Q, X197W, X237T, X241L, X241R, X241V, X253R, X264C, X271I, X282I, X314A, X326F, X343L, X364V, X368A, X368G, X379C, X379E, X382L, X382Q, X382I, X383S, X385G, X385I, X385L, X390A, X390G, X390K, X390W, X390C, X390L, X390V, X398P, X406P, and X423Y, and exhibit from about 80% to about 99.9% identical to amino acids 1-436 of SEQ ID NO: 1 or to amino acids 1-438 of SEQ ID NO: 2.

In still another embodiment, the isolated cellobiohydrolase further comprises a carbohydrate binding module and a linker peptide positioned between the modified Family 7 catalytic domain and the carbohydrate binding module. For example, the carbohydrate binding module may be a Family 1 carbohydrate binding module exhibiting from about 50% to about 99% identity to amino acids 461 to 497 of SEQ ID NO: 1 or to amino acids and comprising, a serine at position 466, an aspartic acid at position 467, a serine at position 471, a valine or serine at position 483, an arginine at position 486, a threonine or glutamine at position 489, or any combination thereof. The position is determined from alignment of a parental Family 1 carbohydrate binding module with amino acids 461 to 497 of SEQ ID NO: 1.

In another aspect, the present invention relates to an isolated cellobiohydrolase comprising a Family 7 catalytic domain, a modified Family 1 carbohydrate binding module, and a linker peptide between the Family 7 catalytic domain and the modified Family 1 carbohydrate binding module. The modified Family 1 carbohydrate binding module comprises one or more amino acid substitutions selected from the group consisting of X466S, X467D, X471S, X483V, X483S, X486R, X489T, and X489Q and exhibits from about 50% to about 99% identity to amino acids 461 to 497 of SEQ ID NO: 1 or to amino acids 474 to 509 of SEQ ID NO: 2. The position(s) the amino acid substitutions are determined from alignment of a parental Family 1 carbohydrate binding module with amino acids 461 to 497 of SEQ ID NO: 1. Such isolated cellobiohydrolase exhibits increased specific activity, reduced inhibition by glucose, reduced inactivation by lignin, increased activity in the presence of lignin, increased activity in the presence of lignocellulose hydrolysate, or any combination thereof, relative to a cellobiohydrolase comprising a parental Family 1 carbohydrate binding domain from which the modified Family 1 carbohydrate binding domain is derived.

In another aspect, the present invention relates to an isolated *Trichoderma reesei* TrCel7A cellobiohydrolase comprising one or more amino acid substitution selected from the group consisting of: T26X, R39X, N45X, S46X, Y51I, D52X, G53X, N54X, G75X, S87X, I93X, F95X, A100X, K102X, L108X, M111X, D114X, F129X, D130X, V131X, P137X, C138X, G139X, A143X, L144X, D150X, V155X, S156X, K181X, I183X, N184X, P194X, N197X, N200X, C209X, S211X, N219X, I237X, D241X, G253X, G260X, N264X, P265X, T271X, L282X, P314X, A316X, N324X, L326X, G339X, F343X, Q351X, K353X, G358X, M364X, D368X, Y370X, A372X, N373X, M374X, L375X, D378X, S379X, S379X, P382X, T383X, E385X, P390X, V393X, S398X, S400X, Q406X, S419X, N420X, F423X, N431X, G435X, N436X, P437X, N441X, G444X, T446X, T447X, R450X, T453X, T454X, T455X, P459X, Q463X, Y466X, G467X, G471X, S475X, G476X, S482X, G483X, C486X, V488X, and L489X. Such isolated *Trichoderma reesei* TrCel7A cellobiohydrolase comprises an amino acid sequence that is from about 75% to about 99.9% identical to amino acids 1-497 of SEQ ID NO: 1.

In one embodiment, the isolated *Trichoderma reesei* TrCel7A cellobiohydrolase may comprise one or more amino acid substitution selected from the group consisting of T26A, T26S, R39L, N45D, S46G, S46A, S46I, S46L, S46T, Y51I, D52R, D52T, D52W, G53A, G53M, G53R, G53W, N54S, N54I, N54D, G75S, S87T, I93V, F95L, F95Y, A100T, A100V, A100W, A100L, A100G, K102S, K102R, L108I, M111T, D114E, F129S, D130N, D130E, V131A, P137S, C138S, G139E, G139M, G139Q, G139S, G139R, A143L, A143G, L144A, L144V, D150N, V155M, S156G, K181L, I183N, N184S, P194Q, N197L, N197V, N197Q, N197W, N197A, N200F, N200C, C209S, S211T, N219S, I237T, D241L, D241R, D241V, G253D, G253R, G260D, N264Y, T271I, L282I, P314A, A316V, N324D, L326F, G339D, F343L, Q351R, K353M, G358S, M364V, D368A, D368G, D378E, Y370H, A372T, N373Y, M374V, L375A, D378E, S379C, S379E, P382L, P382Q, P382I, T383S, T383A, E385G, E385I, E385L, P390A, P390G, P390K, P390W, P390C, P390L, P390V, S398P, S400G, Q406P, S419F, N420D, F423Y, N431R, G435S, N436D, P437T, N441D, G444D, T446A, T447S, R450S, T453I, T453S, T454I, T455A, P459L, Q463L, Q463S, Q463K, Y466S, G467D, G471S, S475N, G476D, S482N, G483V, G483S, C486R, V488D, L489P, and L489Q. Such isolated *Trichoderma reesei* TrCel7A cellobiohydrolase comprises an amino acid sequence that is from about 80% to about 99.9% identical to amino acids 1-497 of SEQ ID NO: 1.

For example, the isolated *Trichoderma reesei* TrCel7A cellobiohydrolase may comprise one or more amino acid substitution selected from the group consisting of T26S, R39L, N45D, S46G, S46A, S46L, S46T, D52R, G53A, G53M, G53R, G53W, N54S, N54I, N54D, S87T, A100T, A100V, A100W, A100L, A100G, K102R, F129S, D130N, G139M, G139S, G139R, A143L, A143G, L144V, I183N, N184S, N197L, N197V, N197Q, N197W, N197A, N200F, N200C, I237T, D241L, D241R, D241V, G253D, G253R, N264C, N264Y, T271I, L282I, P314A, A316V, N324D, L326F, G339D, F343L, G358S, M364V, D368A, D368G, A372T, S379C, P382L, P382Q, P382I, T383S, T383A, E385G, E385I, E385L, P390A, P390G, P390K, P390W, P390C, P390L, P390V, S398P, Q406P, F423Y, N431R, P437T, T446A, T447S, T454I, G467D, S475N, and G483V and exhibit from about 90% to about 99.9% identity to amino acids 1-497 of SEQ ID NO: 1.

The isolated *Trichoderma reesei* TrCel7A cellobiohydrolase as described above exhibits increased specific activity, reduced inhibition by glucose, reduced inactivation by lignin, increased activity in the presence of lignin, increased activity in the presence of lignocellulose hydrolysate, or any combination thereof, relative to a parental *Trichoderma reesei* TrCel7A cellobiohydrolase from which the isolated *Trichoderma reesei* TrCel7A cellobiohydrolase is derived.

In another aspect, the present invention relates to genetic constructs encoding the isolated cellobiohydrolase enzymes as described above.

In still another aspect, the present invention also relates to a genetically modified microbe comprising a genetic construct encoding the isolated cellobiohydrolase enzymes as described above. The genetically modified microbe may be a yeast or filamentous fungus. For example, the genetically modified microbe may be a species of *Saccharomyces, Pichia, Hansenula, Trichoderma, Hypocrea, Aspergillus, Fusarium, Humicola, Chrysosporium, Myceliophthora, Thielavia, Sporotrichum* or *Neurospora*, or a taxonomically equivalent genus thereof.

In still another aspect, the present invention also relates to a process for producing the isolated cellobiohydrolase, as described above, comprising transforming a host microbe with a genetic construct encoding the isolated cellobiohydrolase, selecting a genetically modified microbe expressing the isolated cellobiohydrolase and culturing the genetically modified microbe under conditions that enable the expression of the isolated cellobiohydrolase from the genetic construct.

In still another aspect, the present invention relates to a cellulase enzyme mixture comprising the isolated cellobiohydrolase, as described above.

In still another aspect, the present invention relates to a process for the hydrolyzing a cellulose substrate with a cellulase enzyme mixture comprising the isolated cellobiohydrolase, as described above. In one embodiment, the cellulose substrate is a pretreated lignocellulosic feedstock such as, for example, corn stover, wheat straw, barley straw, rice straw, oat straw, canola straw, soybean stover, corn fiber, sugar beet pulp, pulp mill fines and rejects, sugar cane bagasse, hardwood, softwood, sawdust, switch grass, miscanthus, cord grass, and reed canary grass.

BRIEF DESCRIPTION OF THE DRAWINGS

FIG. 3 provides (a) an alignment of the amino acid sequences of fungal Family 7 catalytic domains and (b) a graphical representation of the relative occurrence of each amino acid in a consensus Family 7 catalytic domain.

FIG. 4 provides an alignment of the TrCel7A (SEQ ID NO: 1) and MtCel7A (SEQ ID NO: 2) cellobiohydrolases. The catalytic amino amino acids (corresponding to E212 and E217 in SEQ ID NO: 1) are indicated by *.

FIG. 5 provides an alignment of the amino acid sequences of fungal Family 1 carbohydrate binding modules.

DETAILED DESCRIPTION OF THE INVENTION

Figure 1:
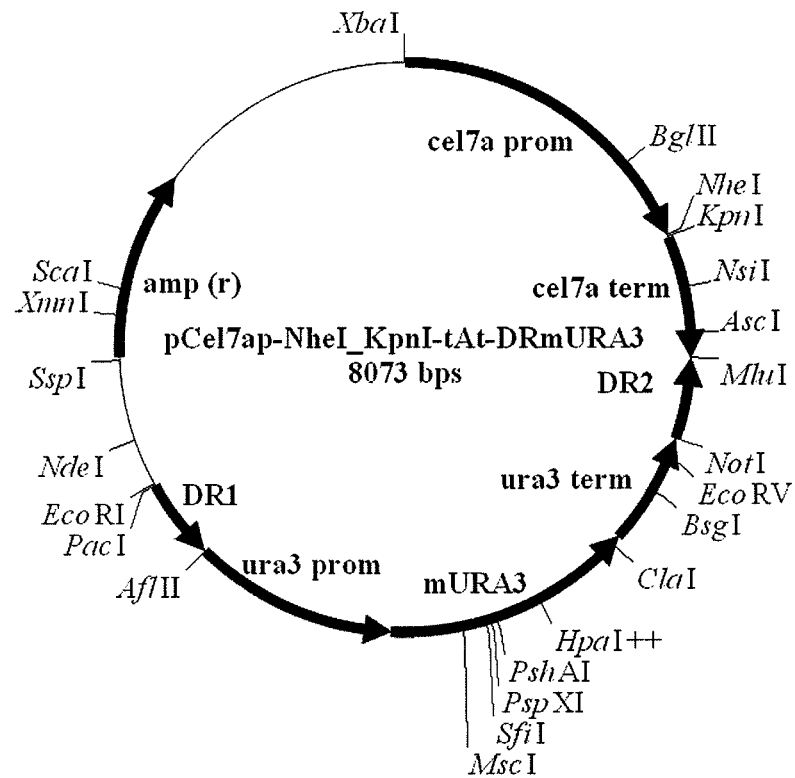
FIG. 1 shows a map of the plasmid vector pTr7Ap-NheI-KpnI-7aT-DRmUra3 used to direct the expression and secretion of isolated cellobiohydrolases in *Trichoderma* host strains.

The present invention relates to isolated cellobiohydrolase enzymes. More specifically, the invention relates to isolated cellobiohydrolases comprising a modified catalytic domain belonging to Glycoside Hydrolase Family 7 and exhibiting increased specific activity, reduced inhibition by glucose, reduced inactivation by lignin, increased activity in the presence of lignin, increased activity in the presence of lignocellulose hydrolysates, or combinations thereof. The present invention also relates to genetic constructs encoding the isolated cellobiohydrolase enzymes, methods for the production of the isolated cellobiohydrolase enzymes from host strains and a process for hydrolysing of cellulosic substrates, such as pretreated lignocellulosic feedstocks, with the isolated cellobiohydrolases.

The following description is of a preferred embodiment by way of example only and without limitation to the combination of features necessary for carrying the invention into effect. The headings provided are not meant to be limiting of the various embodiments of the invention. Terms such as "comprises", "comprising", "comprise", "includes", "including" and "include" are not meant to be limiting. In addition, the use of the singular includes the plural, and "or" means "and/or" unless otherwise stated. Unless otherwise defined herein, all technical and scientific terms used herein have the same meaning as commonly understood by one of ordinary skill in the art.

Family 7 Cellobiohydrolases

As used herein, a Family 7 cellobiohydrolase (a Cel7 cellobiohydrolase, Cel7 CBH enzyme or Cel7 CBH) is a cellulase enzyme comprising a catalytic domain belonging to Glycoside Hydrolase (GH) Family 7 and which is capable of releasing cellobiose from the reducing end of a cellulose chain. For example, a Cel7 CBH may release cellobiose processively from the reducing end of a cellulose chain. Cellulase enzymes comprising a Family 7 catalytic domain from different source organisms are identified by a two-letter designation consisting of the first letters of the genus and species from which the Cel7 CBH is derived, and followed by a capital letter indicating the order in which a particular Cel7 was identified from that organism. For example, the Cel7 CBH enzymes from *Trichoderma reesei* (CBH1) and *Myceliophthora thermophila* (CBH1a) may be referred to as TrCel7A and MtCel7A, respectively.

A catalytic domain is classified into GH Family 7 if it exhibits similarity in its primary, secondary and tertiary protein structures relative to those of other Family 7 cellulases. For example, all Family 7 cellulases comprise two glutamic acid (E) residues which may serve as catalytic residues. These aspartic acid residues are found at positions 212 and 217 of *Trichoderma reesei* CBH1 (Divne, et al., 1998, *J. Mol. Biol.* 275: 309-325). The homologous glutamic acids in the *M. thermophila* CBH1a are found at positions 213 and 218 (FIG. 5).

Family 7 catalytic domains are distinguished by a beta-jelly roll core structure, with much of the protein in random coil held together by disulfide bonds. The three dimensional structures of several Family 7 cellulases are known: *T. reesei* Cel7A (Divne et al., 1994, *Science* 265 (6171): 524-528); *T. reesei* Cel7B (Kleywegt et al., 1997, *J. Biol. Chem.* 272: 383-397), *Fusarium oxysporum* Cel7B (Sulzenbacher, et al., 1996, *Biochemistry* 35(48): 15280-15287), *Humicola insolens* Cel7B (Davies, et al., 1997, *J. Biotechnol.* 57: 91-100), *Melanocarpus albomyces* Cel7B (Parkkinen et al., 2008, *Protein Science* 17: 1383-94), *Phanerochaete chrysosporium* Cel7D (Munoz et al., 2001, *J. Mol. Biol.* 314: 1097-1111), and *Talaromyces emersonii* Cel7A (Grassick et al., 2004, *Eur. J. Biochem.* 271: 495-4506).

Family 7 catalytic domains are found primarily in fungal cellulase enzymes. Non-limiting examples of cellulase enzymes comprising Family 7 catalytic domains are provided in Table 1.

TABLE 1

Fungal Family 7 Catalytic Domains

| SEQ ID NO: | Source Organism | GenBank Accession Number | Abbreviated Name | Identity with amino acids 1-436 of SEQ ID NO: 1 | Identity with amino acids 1-438 of SEQ ID NO: 2 |
|---|---|---|---|---|---|
| 448 | *Hypocrea koningii* | CAA49596.1 | Hkon_CAA49596.1 | 100.0% | 61.5% |
| 449 | *Hypocrea rufa* | AAQ76092.1 | Hruf_AAQ76092.1 | 99.3% | 61.3% |
| 450 | *Hypocrea rufa* | BAA36215.1 | Hruf_BAA36215.1 | 96.3% | 61.1% |
| 451 | *Hypocrea rufa* | CAA37878.1 | Hruf_CAA37878.1 | 96.1% | 61.1% |

TABLE 1-continued

Fungal Family 7 Catalytic Domains

| SEQ ID NO: | Source Organism | GenBank Accession Number | Abbreviated Name | Identity with amino acids 1-436 of SEQ ID NO: 1 | Identity with amino acids 1-438 of SEQ ID NO: 2 |
|---|---|---|---|---|---|
| 452 | *Aspergillus niger* | AAF04491.1 | Anig_AAF04491.1 | 64.7% | 60.5% |
| 453 | *Talaromyces emersonii* | AAL33603.2 | Teme_AAL33603.2 | 64.6% | 61.8% |
| 454 | *Thermoascus aurantiacus* | CAM98447.1 | Taur_CAM98447.1 | 64.6% | 67.0% |
| 455 | *Penicillium occitanis* | AAT99321.1 | Pocc_AAT99321.1 | 63.7% | 59.9% |
| 456 | *Thermoascus aurantiacus* | AAL83303.1 | Taur_AAL83303.1 | 63.7% | 65.9% |
| 457 | *Acremonium thermophilum* | CAM98445.1 | Athe_CAM98445.1 | 63.5% | 74.4% |
| 458 | *Penicillium funiculosum* | CAC85737.1 | Pfun_CAC85737.1 | 63.5% | 60.6% |
| 459 | *Aspergillus niger* | AAF04492.1 | Anig_AAF04492.1 | 61.9% | 62.1% |
| 460 | *Penicillium janthinellum* Biourge | CAA41780.1 | Pjan_CAA41780.1 | 61.7% | 60.8% |
| 461 | *Chrysosporium lucknowense* | AAQ38146.1 | Clue_AAQ38146.1 | 61.5% | 100.0% |
| 462 | *Penicillium chrysogenum* | AAV65115.1 | Pchr_AAV65115.1 | 60.6% | 62.8% |
| 463 | *Aspergillus aculeatus* | BAA25183.1 | Aacu_BAA25183.1 | 60.5% | 59.4% |
| 464 | *Aspergillus nidulans* | EAA66593.1 | Anid_EAA66593.1 | 60.4% | 64.4% |
| 465 | *Emericella nidulans* | AAM54070.1 | Enid_AAM54070.1 | 60.4% | 64.4% |
| 466 | *Thielavia australiensis* | CAD79782.1 | Taus_CAD79782.1 | 60.4% | 84.6% |
| 467 | *Chaetomium thermophilum* | CAM98448.1 | Cthe_CAM98448.1 | 60.0% | 80.9% |
| 468 | *Chaetomium thermophilum* | AAW64926.1 | Cthe_AAW64926.1 | 60.0% | 80.5% |
| 469 | *Acremonium thermophilum* | CAM98446.1 | Athe_CAM98446.1 | 58.8% | 60.4% |
| 470 | *Humicola grisea* var. *thermoidea* | CAA35159.1 | Hgri_CAA35159.1 | 58.2% | 81.4% |
| 471 | *Humicola grisea* var. *thermoidea* | BAA09785.1 | Hgri_BAA09785.1 | 58.2% | 81.6% |
| 472 | *Claviceps purpurea* | CAA68840.1 | Cpur_CAA68840.1 | 56.8% | 63.2% |
| 473 | *Cochliobolus carbonum* | AAC49089.1 | Ccar_AAC49089.1 | 55.6% | 61.9% |
| 474 | *Phanerochaete chrysosporium* | AAB46373.1 | Pchr_AAB46373.1 | 53.7% | 58.5% |
| 475 | *Fusicoccum* sp. | ABS82449.1 | Fsp._ABS82449.1 | 53.5% | 58.9% |
| 476 | *Irpex lacteus* | BAA76364.1 | Ilac_BAA76364.1 | 52.8% | 57.3% |
| 477 | *Phanerochaete chrysosporium* | CAA82761.1 | Pchr_CAA82761.1 | 52.4% | 60.8% |
| 478 | *Irpex lacteus* | BAA76363.1 | Ilac_BAA76363.1 | 51.5% | 55.9% |
| 479 | *Humicola grisea* var. *thermoidea* | AAD11942.1 | Hgri_AAD11942.1 | 50.0% | 57.6% |
| 480 | *Chaetomium thermophilum* | AAY89412.2 | Cthe_AAY89412.2 | 49.8% | 56.4% |
| 481 | *Humicola grisea* var. *thermoidea* | BAA74517.1 | Hgri_BAA74517.1 | 49.7% | 57.4% |
| 482 | *Magnaporthe grisea* | XP_367082.1 | Mgri_XP_367082.1 | 49.7% | 49.5% |
| 483 | *Melanocarpus albomyces* | AAU96164.1 | Malb_AAU96164.1 | 49.3% | 54.5% |
| 484 | *Phanerochaete chrysosporium* | CAA38274.1 | Pchr_CAA38274.1 | 49.1% | 53.2% |
| 485 | *Volvariella volvacea* | AAD41096.1 | Vvol_AAD41096.1 | 44.7% | 44.8% |

Full sequence of each enzyme from the accession number stated in the table (including CBM and signal peptide if any) were aligned with reference sequences (amino acids 1-436 of SEQ ID NO: 1 and amino acids 1-438 of SEQ ID NO: 2) using ClustalW Multiple Alignment tool, with default settings, found in the BioEdit software version 7.0.9.0(6/27/07). Percent identity with reference sequences was calculated only using sequences showing alignment to the reference sequences and after removing all amino acids before or after the reference sequences.

Figures 1, 3B:
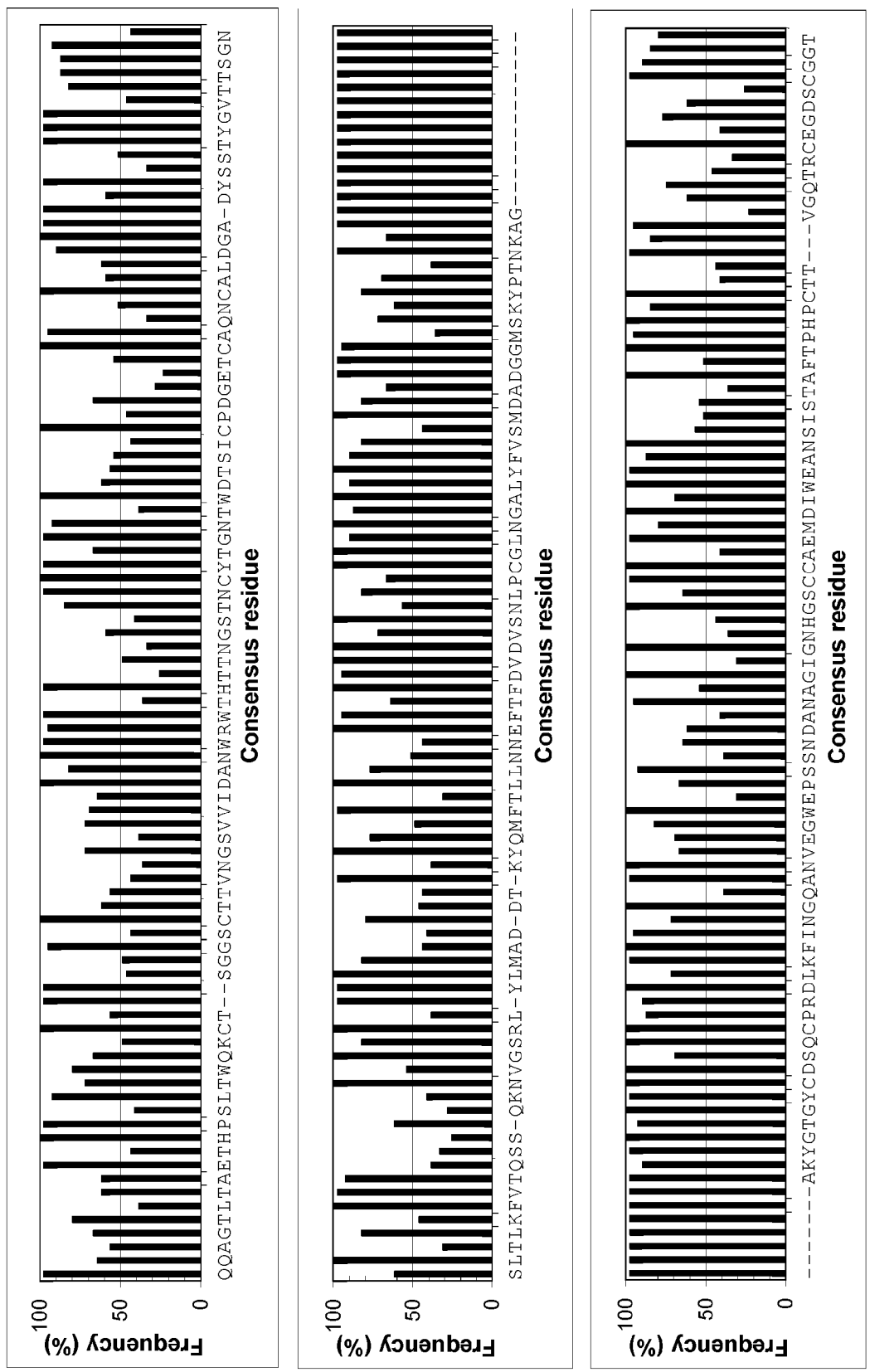
Figures 2, 3B:
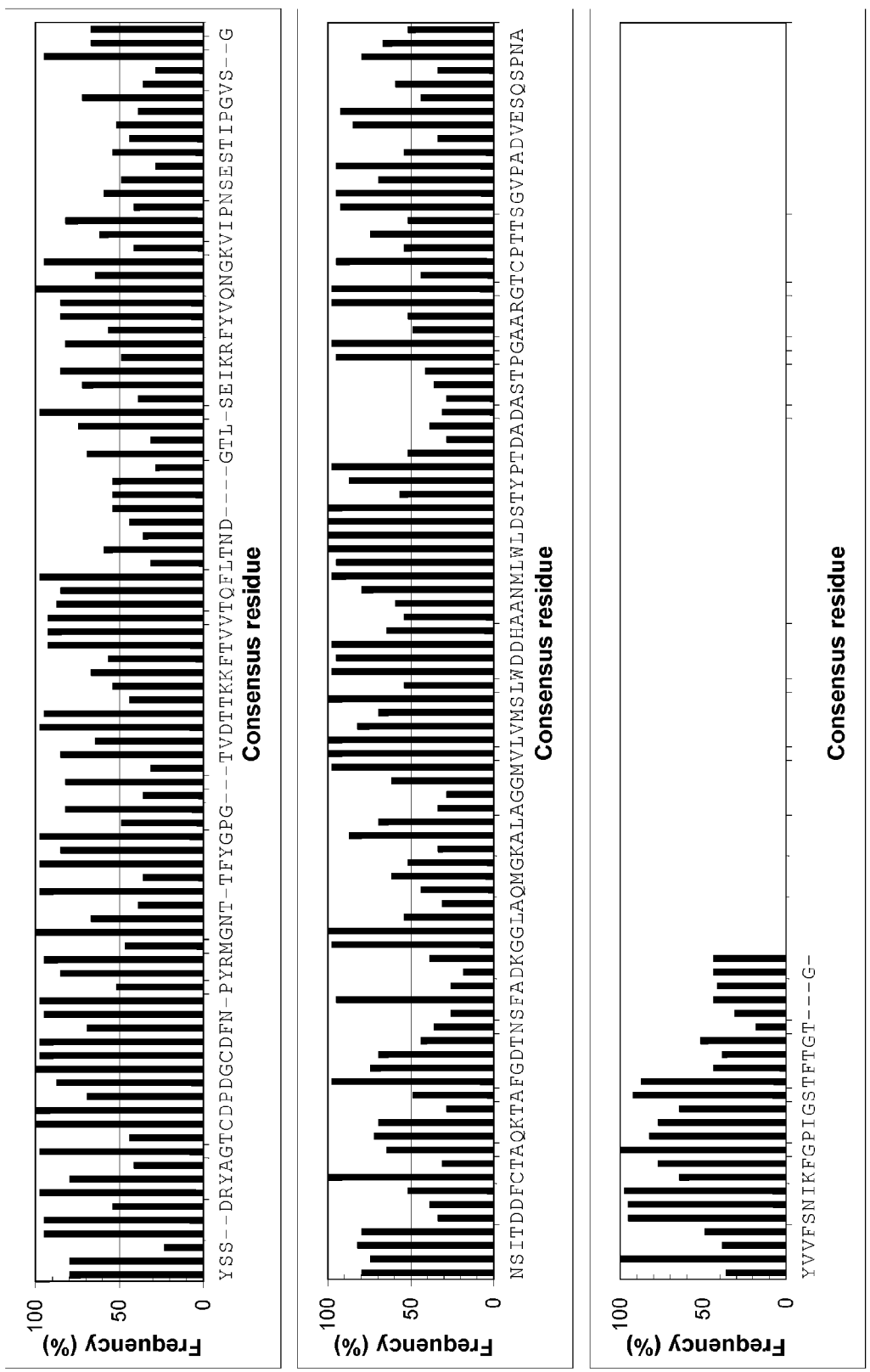

As shown in Table 1 and FIG. 3, there is a high degree of conservation of primary amino acid sequence among Family 7 cellobiohydrolases. Multiple amino acid sequence alignment of the Family 7 catalytic domains of 38 currently known fungal cellobiohydrolase enzymes shows that most naturally occurring Family 7 CBH catalytic domains exhibit from about 45% to about 100% amino acid sequence identity to amino acids 1-436 comprising the catalytic domain of TrCel7A (Table 1) and from about 45% to 100% amino acid sequence identity to amino acids 1-438 comprising the catalytic domain of MtCel7A. In particular, there are several regions of very high amino acid sequence conservation within the Family 7 catalytic domains of fungal cellobiohydrolases including, for example, from amino acids 165-188, 360-383 and 207-222, containing the catalytic amino acids 212 and 217.

By "TrCel7A cellobiohydrolase" or "TrCel7A" it is meant the Family 7 cellobiohydrolase produced by *Trichoderma reesei* defined by the amino acid sequence of SEQ ID NO: 1. TrCel7A cellobiohydrolase is also known as *Trichoderma reesei* exoglucanase I, cellobiohydrolase I or CBH1. By "native" or "wild type" TrCel7A (also annotated as TrCel7A$^{wt}$), it is meant the TrCel7A of SEQ ID NO: 1 without any amino acid substitutions.

By "MtCel7A cellobiohydrolase" or "MtCel7A" it is meant the Family 7 cellobiohydrolase produced by *Myceliophthora thermophila* defined by the amino acid sequence of SEQ ID NO: 2. MtCel7A cellobiohydrolase is also known as *Myceliophthora thermophila* cellobiohydrolase Ia or CBH1a. By "native" or "wild type" MtCel7A (also annotated as MtCel7A$^{wt}$), it is meant the MtCel7A of SEQ ID NO: 2 without any amino acid substitutions.

Isolated Cellobiohydrolases

By "isolated cellobiohydrolase" or "isolated CBH", it is meant an enzyme preparation comprising a CBH enzyme and no more than 10% of polypeptides with which it is naturally associated. For example, the enzyme preparation may comprise a CBH enzyme and no more than 8%, 6%, 4%, 2%, 1%, 0%, or any amount therebetween, of polypeptides with which it is naturally associated. The isolated cellobiohydrolase of the present invention may be produced by recombinant means from a genetically modified microbe, as described herein below.

In one aspect of the present invention, an isolated cellobiohydrolase comprises a modified Family 7 catalytic domain (a) having one or more amino acid substitution at position 26, 39, 45, 46, 51, 52, 53, 54, 75, 87, 93, 95, 102, 111, 114, 129, 130, 131, 138, 139, 143, 144, 150, 155, 156, 181, 183, 184, 193, 197, 209, 211, 219, 237, 241, 253, 260, 264, 271, 282, 314, 316, 324, 326, 339, 343, 351, 353, 358, 364, 368, 370, 373, 374, 375, 378, 379, 382, 383, 385, 390, 398, 400, 406, 419, 420, 423, 435, 436, or any combination thereof, the position(s) of such amino acid substitutions being determined by amino acid sequence alignment of a parental Family 7 catalytic domain, from which the modified Family 7 catalytic domain is derived, with amino acids 1-436 of SEQ ID NO: 1 or with amino acids 1-438 of SEQ ID NO: 2 and (b) exhibiting from about 47% to about 99.9% amino acid sequence identity to amino acids 1-436 of SEQ ID NO: 1 or to amino acids 1-438 of SEQ ID NO: 2. For example, the isolated cellobiohydrolase enzyme may comprise a modified Family 7 catalytic domain having one or more amino acid substitution at position 26, 39, 45, 46, 52, 53, 54, 87, 95, 102, 129, 130, 139, 143, 144, 183, 184, 197, 237, 241, 253, 264, 271, 282, 314, 316, 324, 326, 339, 343, 358, 364, 368, 379, 382, 385, 390, 398, 406, 423, or any combination thereof.

By "amino acid sequence alignment", it is meant the alignment of one or more amino acid sequences to a reference sequence in order to optimize the sequence similarity between the aligned sequences. Methods for aligning two or more amino acid sequences include, but are not limited to, BLAST (BLAST and BLAST 2.0; Altschul et al., 1997 and 1990), the alignment algorithm of Smith & Waterman (1981), the homology alignment algorithm of Needleman & Wunsch (1970), the search for similarity method of Pearson & Lipman (1988), computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection. Alignments of 38 Family 7 catalytic domain amino acid sequences and 38 Family 1 carbohydrate binding module sequences are provided in FIGS. 3 and 5, respectively.

Once the alignment is complete, one of skill in the art can determine (a) the positions of the amino acids within a given parental Family 7 catalytic domain that correspond to those positions 26, 39, 45, 46, 51, 52, 53, 54, 75, 87, 93, 95, 102, 111, 114, 129, 130, 131, 138, 139, 143, 144, 150, 155, 156, 181, 183, 184, 197, 209, 211, 219, 237, 241, 253, 260, 264271, 282, 314, 316, 324, 326, 339, 343, 351, 353, 358, 364, 368, 370, 373, 374, 375, 378, 379, 382, 383, 385, 390, 398, 400, 406, 419, 420, 423, 435, and 436 of the TrCel7A cellobiohydrolase of SEQ ID NO: 1 and (b) the amino acid sequence identity of a given Family 7 catalytic domain sequence to amino acids 1-436 of SEQ ID NO: 1 or amino acids 1-438 of SEQ ID NO: 2.

By "parental Family 7 catalytic domain", it is meant a Family 7 catalytic domain that does not contain a substitution of its original amino acid at position 26, 39, 45, 46, 51, 52, 53, 54, 75, 87, 93, 95, 102, 111, 114, 129, 130, 131, 138, 139, 143, 144, 150, 155, 156, 181, 183, 184, 197, 209, 211, 219, 237, 241, 253, 260, 264, 271, 282, 314, 316, 324, 326, 339, 343, 351, 353, 358, 364, 368, 370, 373, 374, 375, 378, 379, 382, 383, 385, 390, 398, 400, 406, 419, 420, 423, 435, 436, or any combination thereof. It will be understood that a parental Family 7 catalytic domain may be a wild-type or native Family 7 catalytic domain or a Family 7 catalytic domain that contains amino acid substitutions at positions other than 26, 39, 45, 46, 51, 52, 53, 54, 75, 87, 93, 95, 102, 111, 114, 129, 130, 131, 138, 139, 143, 144, 150, 155, 156, 181, 183, 184, 197, 209, 211, 219, 237, 241, 253, 260, 264271, 282, 314, 316, 324, 326, 339, 343, 351, 353, 358, 364, 368, 370, 373, 374, 375, 378, 379, 382, 383, 385, 390, 398, 400, 406, 419, 420, 423, 435, and/or 436.

A parental Family 7 catalytic domain may be derived from one or more cellulase enzymes from any source organism, including but not limited to species of *Aspergillus, Chaetomium, Chrysosporium, Coprinus, Corynascus, Ctenomyces, Fomitopsis, Fusarium, Humicola, Magnaporthe, Melanocarpus, Myceliophthora, Neurospora, Phanerochaete, Podospora, Rhizomucor, Sporotrichum, Talaromyces, Thermoascus, Thermomyces* and *Thielavia*. For example, a parental Family 7 catalytic domain may be derived from *Trichoderma reesei* Cel7A (SEQ ID NO: 1), *Myceliophthora thermophile* Cel7A (SEQ ID NO: 2), or from any cellulase comprising a Family 7 catalytic domain listed in Table 1.

In order to assist one of skill in the art regarding those amino acid positions a parental Family 7 catalytic domain at which amino acid substitutions (other than those present in the corresponding modified Family 7 catalytic domain) may be made and produce an active cellobiohydrolase, an alignment of 38 Family 7 catalytic domains derived from fungal sources along with a consensus Family 7 catalytic domain consisting of the amino acids that naturally occur with the highest frequency at each position is provided in FIG. 3 along with a graph showing the frequency of occurrence of each amino acid of the consensus sequence at each position. Using this information, one of skill in the art would recognize regions of low sequence conservation and choose such regions for introduction of amino acid substitutions that are not likely to compromise significantly the function of the enzyme. Non-limiting examples of such regions include, for example, the regions between positions 232-247, 309-322 and 327-359.

In another embodiment of the invention, the isolated cellobiohydrolase comprises a modified Family 7 catalytic domain (a) having one or more amino acid substitution selected from the group consisting of: X26A, X45D, X46A, X46L, X46T, X51I, X52R, X52W, X53A, X53M, X53R, X53W, X54S, X54I, X54D, X75S, X87T, X93V, X95L, X95Y, X102R, X111T, X129S, X130N, X130E, X138S, X139E, X139M, X139Q, X139S, X139R, X143L, X143G, X144A, X144V, X150N, X181L, X183N, X184S, X197L, X197V, X197Q, X197W, X219S, X237T, X241L, X241R, X241V, X253R, X260D, X264C, X264Y, X271I, X326F, X343L, X351R, X353M, X356I, X356A, X364V, X368A, X373Y, X374V, X375A, X378E, X379C, X379E, X382L, X382Q, X382I, X383S, X385I, X385L, X390A, X390G, X390K, X390W, X390C, X390L, X390V, X400G, X406P, X419F, and X436D, and (b) exhibits from about 65% to about 99.9% amino acid sequence identity to amino acids 1-436 of SEQ ID NO: 1 or to amino acids 1-438 of SEQ ID NO: 2. For example, the modified Family 7 catalytic domain may have one or more amino acid substitution selected from the group consisting of: X45D, X46A, X46L, X46T, X52R, X53A, X53M, X53R, X53W, X54S, X54I, X54D, X87T, X95L, X95Y, X102R, X129S, X130N, X139M, X139S, X139R, X143L, X143G, X144V, X183N, X184S, X197L, X197V, X197Q, X197W, X237T, X241L, X241R, X241V, X253R, X264C, X271I, X282I, X314A, X326F, X343L, X356I, X364V, X368A, X368G, X379C, X379E, X382L, X382Q, X382I, X383S, X385G, X385I, X385L, X390A, X390G, X390K, X390W, X390C, X390L, X390V, X398P, X406P, and X423Y.

In another embodiment, the isolated cellobiohydrolase comprising a modified Family 7 catalytic domain may further comprise a carbohydrate binding module (CBM) and a linker peptide positioned between the modified Family 7 catalytic domain and the carbohydrate binding module. For example, the CBM may be a Family 1 CBM. By "Family 1 CBM" or "Family 1 carbohydrate binding module" it is meant any polypeptide that exhibits binding to crystalline cellulose and comprises an amino acid sequence that is classified as a Family 1 carbohydrate binding module (or Family 1 CBM) according to the CAZy system (see URL: cazy.org/Carbohydrate-Binding-Modules.html). FIG. 5 provides an alignment of 38 Family 1 CBM amino acid sequences showing the positions of the four highly conserved cysteines which form two disulfide bridges. Three aromatic amino acids (tryptophan, tyrosine or phenylalanine) are also conserved, form a planar surface and interact directly with the glucose units of the cellulose polymer via van der Waals' interactions. The identity of the 38 CBM sequences to the CBMs of TrCel7A and MtCel7a are provided in Table 2.

The term "linker peptide" is intended to be understood as a stretch of amino acids located between two functional domains and comprising from about 6 to about 60 amino acids. Linker peptides can be identified from amino acid sequence information using models (Bae, et al. (2008) *Journal of the American Statistical Association*, 103(483):1085-99; Suyama, and Ohara, (2003) *Bioinformatics*, 19(5):673-4). Gilkes et al., (1991 *Microbiology Reviews*, 55(2):303-315) presents the sequences of linkers from a variety of cellulases and other bacterial and fungal proteins encompassed by this definition. Linker peptides are typically basic peptides, particularly enriched in serine, threonine and proline, relative to non-linker sequences. As presented in Table I of Gilkes et al (1991), proline, serine and threonine account for 50% or more of the amino acids in all linker peptide sequences from bacterial and fungal glycoside hydrolases (xylanases, endoglucanases, exoglucanases). For the purposes defined herein, a linker peptide maybe be defined as a stretch of about 6 to about 60 amino acids, at least 50% of which are proline, serine or threonine, that is positioned between a catalytic domain and a CBM, two catalytic domains, two CBMs, or between another functional domain and either a catalytic domain or a CBM. Proline, serine and threonine may account for 50%, 60%, 70%, 80% 90% or 100% of the amino acids in the linker peptide ((# proline+threonine+serine)/# amino acids in linker×100%). One of skill in the art recognizes that the amino acid sequence of a given linker may be modified by the addition, deletion or substitution of one or more amino acids and still be considered a linker peptide.

In another aspect, the isolated cellobiohydrolase comprises a parental or modified Family 7 catalytic domain, a modified Family 1 CBM, and a linker peptide positioned therebetween, the modified Family 1 carbohydrate binding module exhibiting from about 50% to about 99% identity to amino acids 463 to 497 of SEQ ID NO: 1 or to amino acids 474 to 509 of SEQ ID NO: 2 and having one or more amino acid substitutions selected from the group consisting of X466S, X467D, X471S, X483V, X486R, X489T, X489Q, or any combination thereof, the position determined from alignment of a parental Family 1 carbohydrate binding module with amino acids 463 to 497 of SEQ ID NO: 1 or with amino acids 474 to 509 of SEQ ID NO: 2. As described above, there are many method several methods available for aligning the amino acid sequence of a parental Family 1 CBM to a reference Family 1 CBM such as amino acids 463 to 497 of SEQ ID NO: 1 or amino acids 474 to 509 of SEQ ID NO: 2 in order to determine (a) the positions of the amino acids within a given parental Family 1 CBM that correspond to positions 466, 467, 471, 483, 486, and 489 of SEQ ID NO: 1 and (b) the amino acid sequence identity of a given parental Family 1 CBM sequence to amino acids 463 to 497 of SEQ ID NO: 1 or with amino acids 474 to 509 of SEQ ID NO: 2.

The isolated cellobiohydrolase comprising a parental or modified Family 7 catalytic domain and a modified Family 1 CBM exhibits increased specific activity, reduced inhibition by glucose, reduced inactivation by lignin, increased activity in the presence of lignin, increased activity in the presence of lignocellulose hydrolysate, or any combination thereof, relative to a cellobiohydrolase comprising a parental Family 1 carbohydrate binding module from which the modified Family 1 carbohydrate binding domain is derived.

By "parental Family 1 carbohydrate binding module" it is meant a Family 1 carbohydrate binding module that does not contain a substitution of its original amino acid at position 466, 467, 471, 483, 486, 489 or any combination thereof. It will be understood that a parental Family 1 carbohydrate binding module may be a wild-type or native Family 1 carbohydrate binding module or a Family 1 carbohydrate binding module that contains amino acid substitutions at positions other than 466, 467, 471, 483, 486, and/or 489. A parental Family 1 carbohydrate binding module may be derived from one or more cellulase enzymes from any source organism, including but not limited to species of *Aspergillus, Chaetomium, Chrysosporium, Coprinus, Corynascus, Ctenomyces, Fomitopsis, Fusarium, Humicola, Magnaporthe, Melanocarpus, Myceliophthora, Neurospora, Phanerochaete, Podospora, Rhizomucor, Sporotrichum, Talaromyces, Thermoascus, Thermomyces* and *Thielavia*. For example, a parental Family 1 CBM may be derived from *Trichoderma reesei* Cel7A (SEQ ID NO: 1), *Myceliophthora thermophile* Cel7A (SEQ ID NO: 2), or from any cellulase comprising a Family 1 carbohydrate binding module listed in Table 2.

Family 1 carbohydrate binding modules are found primarily in fungal cellulase enzymes. Non-limiting examples of cellulase enzymes comprising Family 1 carbohydrate binding modules are provided in Table 2.

TABLE 2

Fungal Family 1 Carbohydrate Binding Modules

| SEQ ID NO: | Organism | GenBank Accession Number | Abbreviated Name | Identity with amino acids 463-497 of SEQ ID NO: 1 | Identity with amino acids 474-509 of SEQ ID NO: 2 |
| --- | --- | --- | --- | --- | --- |
| 486 | Hypocrea koningii | CAA49596.1 | Hkon_CAA49596.1 | 97.2% | 61.1% |
| 487 | Hypocrea rufa | AAQ76092.1 | Hruf_AAQ76092.1 | 97.2% | 61.1% |
| 488 | Hypocrea rufa | BAA36215.1 | Hruf_BAA36215.1 | 91.6% | 61.1% |
| 489 | Hypocrea rufa | CAA37878.1 | Hruf_CAA37878.1 | 88.8% | 61.1% |
| 490 | Penicillium funiculosum | CAC85737.1 | Pfun_CAC85737.1 | 72.2% | 63.8% |
| 491 | Volvariella volvacea | AAD41096.1 | Vvol_AAD41096.1 | 72.2% | 58.3% |
| 492 | Penicillium occitanis | AAT99321.1 | Pocc_AAT99321.1 | 69.4% | 63.8% |
| 493 | Phanerochaete chrysosporium | AAB46373.1 | Pchr_AAB46373.1 | 66.6% | 58.3% |
| 494 | Aspergillus aculeatus | BAA25183.1 | Aacu_BAA25183.1 | 63.8% | 69.4% |
| 495 | Chaetomium thermophilum | CAM98448.1 | Cthe_CAM98448.1 | 63.8% | 58.3% |
| 496 | Chaetomium thermophilum | AAW64926.1 | Cthe_AAW64926.1 | 63.8% | 58.3% |
| 497 | Irpex lacteus | BAA76363.1 | Ilac_BAA76363.1 | 63.8% | 55.5% |
| 498 | Acremonium thermophilum | CAM98445.1 | Athe_CAM98445.1 | 61.1% | 66.6% |

TABLE 2-continued

Fungal Family 1 Carbohydrate Binding Modules

| SEQ ID NO: | Organism | GenBank Accession Number | Abbreviated Name | Identity with amino acids 463-497 of SEQ ID NO: 1 | Identity with amino acids 474-509 of SEQ ID NO: 2 |
|---|---|---|---|---|---|
| 499 | *Aspergillus niger* | AAF04492.1 | Anig_AAF04492.1 | 61.1% | 63.8% |
| 500 | *Chrysosporium lucknowense* | AAQ38146.1 | Cluc_AAQ38146.1 | 61.1% | 100.0% |
| 501 | *Aspergillus nidulans* | EAA66593.1 | Anid_EAA66593.1 | 58.3% | 66.6% |
| 502 | *Emericella nidulans* | AAM54070.1 | Enid_AAM54070.1 | 58.3% | 66.6% |
| 503 | *Irpex lacteus* | BAA76364.1 | Ilac_BAA76364.1 | 58.3% | 52.7% |
| 504 | *Penicillium chrysogenum* | AAV65115.1 | Pchr_AAV65115.1 | 58.3% | 63.8% |
| 505 | *Phanerochaete chrysosporium* | CAA82761.1 | Pchr_CAA82761.1 | 58.3% | 47.2% |
| 506 | *Humicola grisea var. thermoidea* | BAA09785.1 | Hgri_BAA09785.1 | 52.7% | 83.3% |
| 507 | *Thielavia australiensis* | CAD79782.1 | Taus_CAD79782.1 | 52.7% | 77.7% |
| 508 | *Humicola grisea var. thermoidea* | CAA35159.1 | Hgri_CAA35159.1 | 50.0% | 80.5% |
| 509 | *Penicillium janthinellum* Biourge | CAA41780.1 | Pjan_CAA41780.1 | 50.0% | 72.2% |

Full sequence of each enzyme from the accession number stated in the table (including CBM and signal peptide if any) were aligned with reference sequences (amino acids 463 to 497 of SEQ ID NO: 1 or amino acids 474 to 509 of SEQ ID NO: 2) using ClustalW Multiple Alignment tool, with default settings, found in the BioEdit software version 7.0.9.0(6/27/07). Percent identity with reference sequences was calculated only using sequences showing alignment to the reference sequences and after removing all amino acids before or after the reference sequences.

As used herein in respect of modified Family 7 catalytic domains or modified Family 1 CBMs, "derived from" refers to the isolation of a target nucleic acid sequence element encoding the desired modified Family 7 catalytic domain or Family 1 CBM using genetic material or nucleic acid or amino acid sequence information specific to the corresponding parental Family 7 catalytic domain or parental Family 1 CBM. As is known by one of skill in the art, such material or sequence information can be used to generate a nucleic acid sequence encoding the desired modified Family 7 catalytic domain or modified Family 1 CBM using one or more molecular biology techniques including, but not limited to, cloning, sub-cloning, amplification by PCR, in vitro synthesis, and the like.

In yet another aspect, the isolated cellobiohydrolase may be an isolated *Trichoderma reesei* TrCel7A cellobiohydrolase comprising one or more amino acid substitution selected from the group consisting of: T26X, R39L, N45D, S46X, Y51I, D52X, G53X, N54X, G75X, S87X, I93X, F95X, A100X, K102X, L108X, M111X, D114X, F129X, D130X, V131X, P137X, C138X, G139X, A143X, L144X, D150X, V155X, S156X, K181X, I183X, N184X, P194X, N197X, N200X, C209X, S211X, N219X, I237X, D241X, G253X, G260X, N264X, T271X, L282X, P314X, A316X, N324X, L326X, G339X, F343X, Q351X, K353X, T356X, G358X, M364X, D368X, Y370X, A372X, N373X, M374X, L375X, D378X, S379X, S379X, P382X, T383X, E385X, P390X, V393X, S398X, S400X, Q406X, S419X, N420X, F423X, N431X, G435X, N436X, P437X, N441X, G444X, T446X, T447X, R450X, T453X, T454X, T455X, P459X, Q463X, Y466X, G467X, G471X, S475X, G476X, S482X, G483X, G483X, C486X, V488X, and L489X, and exhibiting from about 75% to about 99.9% amino acid sequence identity to amino acids 1-497 of SEQ ID NO: 1.

For example, the isolated *Trichoderma reesei* TrCel7A cellobiohydrolase may comprise one or more amino acid substitution selected from the group consisting of: T26A, T26S, R39L, N45D, S46G, S46A, S46I, S46L, S46T, Y51I, D52R, D52T, D52W, G53A, G53M, G53R, G53W, N54S, N54I, N54D, G75S, S87T, I93V, F95L, F95Y, A100T, A100V, A100W, A100L, A100G, K102S, K102R, L108I, M111T, D114E, F129S, D130N, D130E, V131A, P137S, C138S, G139E, G139M, G139Q, G139S, G139R, A143L, A143G, L144A, L144V, D150N, V155M, S156G, K181L, I183N, N184S, P194Q, N197L, N197V, N197Q, N197W, N197A, N200F, N200C, C209S, S211T, N219S, I237T, D241L, D241R, D241V, G253D, G253R, G260D, N264Y, T271I, L282I, P314A, A316V, N324D, L326F, G339D, F343L, Q351R, K353M, G358S, M364V, D368A, D368G, D378E, Y370H, A372T, N373Y, M374V, L375A, D378E, S379C, S379E, P382L, P382Q, P382I, T383S, T383A, E385G, E385I, E385L, P390A, P390G, P390K, P390W, P390C, P390L, P390V, V393A, S398P, S400G, Q406P, S419F, N420D, F423Y, N431R, G435S, N436D, P437T, N441D, G444D, T446A, T447S, R450S, T453I, T453S, T454I, T455A, P459L, Q463L, Q463S, Q463K, Y466S, G467D, G471S, S475N, G476D, S482N, G483V, G483S, C486R, V488D, L489P, and L489Q and exhibit from about 80% to about 99.9% amino acid sequence identity to amino acids 1-497 of SEQ ID NO: 1.

In one embodiment, the isolated *Trichoderma reesei* TrCel7A cellobiohydrolase may comprise one or more amino acid substitution selected from the group consisting of: T26S, R39L, N45D, S46G, S46A, S46L, S46T, D52R, G53A, G53M, G53R, G53W, N54S, N54I, N54D, S87T, A100T, A100V, A100W, A100L, A100G, K102R, F129S, D130N, G139M, G139S, G139R, A143L, A143G, L144V, I183N, N184S, N197L, N197V, N197Q, N197W, N197A, N200F, N200C, I237T, D241L, D241R, D241V, G253D, G253R, N264C, N264Y, T271I, T281A, L282I, P314A, A316V, N324D, L326F, G339D, F343L, T356I, G358S, M364V, D368A, D368G, A372T, S379C, P382L, P382Q, P382I, T383S, T383A, E385G, E385I, E385L, P390A, P390G, P390K, P390W, P390C, P390L, P390V, V393A, S398P, Q406P, F423Y, N431R, P437T, T446A, T447S, T454I, G467D, S475N, and G483V, and exhibit from about 90% to about 99.9% amino acid sequence identity to amino acids 1-497 of SEQ ID NO: 1.

The isolated TrCel7A cellobiohydrolase may be derived from the wild-type or native TrCel7A cellobiohydrolase of SEQ ID NO: 1 or from a parental TrCel7A cellobiohydrolase comprising amino acid deletions or insertions, or amino acid substitutions other than T26X, R39L, N45D, S46X, Y51I, D52X, G53X, N54X, G75X, S87X, I93X, F95X, A100X, K102X, L108X, M111X, D114X, F129X, D130X, V131X, P137X, C138X, G139X, A143X, L144X, D150X, V155X, S156X, K181X, I183X, N184X, P194X, N197X, N200X, C209X, S211X, N219X, I237X, D241X, D249X, G253X, G260X, N264X, T271X, L282X, P314X, A316X, N324X, L326X, G339X, F343X, Q351X, K353X, G358X, M364X, D368X, Y370X, A372X, N373X, M374X, L375X, D378X, S379X, S379X, P382X, T383X, E385X, P390X, V393X, S398X, S400X, Q406X, S419X, N420X, F423X, N431X, G435X, N436X, P437X, N441X, G444X, T446X, T447X, R450X, T453X, T454X, T455X, P459X, Q463X, Y466X, G467X, G471X, S475X, G476X, S482X, G483X, G483X, C486X, V488X, and L489X.

A list of isolated TrCel7A cellobiohydrolase in accordance with the present invention, which is not to be considered limiting in any manner, is presented in Table 3.

TABLE 3

Isolated Cellobiohydrolases derived from TrCel7A

| SEQ ID NO: | Isolated CBH |
|---|---|
| 3 | TrCel7A-P13H |
| 4 | TrCel7A-P13T |
| 5 | TrCel7A-G22D |
| 6 | TrCel7A-T26A |
| 7 | TrCel7A-T26S |
| 8 | TrCel7A-Q27L |
| 9 | TrCel7A-R39L |
| 10 | TrCel7A-N45D |
| 11 | TrCel7A-S46A |
| 12 | TrCel7A-S46G |
| 13 | TrCel7A-S46L |
| 14 | TrCel7A-S46T |
| 15 | TrCel7A-Y51I |
| 16 | TrCel7A-D52R |
| 17 | TrCel7A-D52T |
| 18 | TrCel7A-D52W |
| 19 | TrCel7A-G53A |
| 20 | TrCel7A-G53M |
| 21 | TrCel7A-G53R |
| 22 | TrCel7A-G53W |
| 23 | TrCel7A-N54D |
| 24 | TrCel7A-N54I |
| 25 | TrCel7A-N54S |
| 26 | TrCel7A-T59A |
| 27 | TrCel7A-G75S |
| 28 | TrCel7A-S87T |
| 29 | TrCel7A-G88V |
| 30 | TrCel7A-I93V |
| 31 | TrCel7A-F95L |
| 32 | TrCel7A-F95Y |
| 33 | TrCel7A-A100G |
| 34 | TrCel7A-A100L |
| 35 | TrCel7A-A100T |
| 36 | TrCel7A-A100V |
| 37 | TrCel7A-A100W |
| 38 | TrCel7A-K102R |
| 39 | TrCel7A-K102S |
| 40 | TrCel7A-L108I |
| 41 | TrCel7A-M111T |
| 42 | TrCel7A-D114E |
| 43 | TrCel7A-F129S |
| 44 | TrCel7A-D130E |
| 45 | TrCel7A-D130N |
| 46 | TrCel7A-V131A |
| 47 | TrCel7A-P137S |
| 48 | TrCel7A-C138S |
| 49 | TrCel7A-G139E |
| 50 | TrCel7A-G139M |
| 51 | TrCel7A-G139Q |
| 52 | TrCel7A-G139R |
| 53 | TrCel7A-G139S |
| 54 | TrCel7A-A143G |
| 55 | TrCel7A-A143L |
| 56 | TrCel7A-L144A |
| 57 | TrCel7A-L144V |
| 58 | TrCel7A-D150N |
| 59 | TrCel7A-V155M |
| 60 | TrCel7A-S156G |
| 61 | TrCel7A-K181L |
| 62 | TrCel7A-I183N |
| 63 | TrCel7A-N184S |
| 64 | TrCel7A-Q186K |
| 65 | TrCel7A-E193G |
| 66 | TrCel7A-P194Q |
| 67 | TrCel7A-N197A |

TABLE 3-continued

Isolated Cellobiohydrolases derived from TrCel7A

| SEQ ID NO: | Isolated CBH |
|---|---|
| 68 | TrCel7A-N197L |
| 69 | TrCel7A-N197Q |
| 70 | TrCel7A-N197V |
| 71 | TrCel7A-N197W |
| 72 | TrCel7A-N200C |
| 73 | TrCel7A-N200F |
| 74 | TrCel7A-C209S |
| 75 | TrCel7A-S211T |
| 76 | TrCel7A-M213I |
| 77 | TrCel7A-N219S |
| 78 | TrCel7A-I237T |
| 79 | TrCel7A-D241L |
| 80 | TrCel7A-D241R |
| 81 | TrCel7A-D241V |
| 82 | TrCel7A-T246S |
| 83 | TrCel7A-D249C |
| 84 | TrCel7A-D249N |
| 85 | TrCel7A-G253D |
| 86 | TrCel7A-G253R |
| 87 | TrCel7A-G260D |
| 88 | TrCel7A-N264C |
| 89 | TrCel7A-N264Y |
| 90 | TrCel7A-P265T |
| 91 | TrCel7A-T271I |
| 92 | TrCel7A-T281A |
| 93 | TrCel7A-T281I |
| 94 | TrCel7A-K286E |
| 95 | TrCel7A-A299T |
| 96 | TrCel7A-F311L |
| 97 | TrCel7A-P314A |
| 98 | TrCel7A-A316V |
| 99 | TrCel7A-N324D |
| 100 | TrCel7A-E325K |
| 101 | TrCel7A-L326F |
| 102 | TrCel7A-N327Y |
| 103 | TrCel7A-T332I |
| 104 | TrCel7A-G339D |
| 105 | TrCel7A-F343L |
| 106 | TrCel7A-Q351R |
| 107 | TrCel7A-K353M |
| 108 | TrCel7A-T356A |
| 109 | TrCel7A-T356I |
| 110 | TrCel7A-G358S |
| 111 | TrCel7A-M364V |
| 112 | TrCel7A-D368A |
| 113 | TrCel7A-D368G |
| 114 | TrCel7A-Y370H |
| 115 | TrCel7A-A372T |
| 116 | TrCel7A-N373Y |
| 117 | TrCel7A-M374V |
| 118 | TrCel7A-L375A |
| 119 | TrCel7A-D378E |
| 120 | TrCel7A-S379C |
| 121 | TrCel7A-S379E |
| 122 | TrCel7A-P382I |
| 123 | TrCel7A-P382L |
| 124 | TrCel7A-P382Q |
| 125 | TrCel7A-T383A |
| 126 | TrCel7A-T383S |
| 127 | TrCel7A-E385G |
| 128 | TrCel7A-E385I |
| 129 | TrCel7A-E385L |
| 130 | TrCel7A-P390A |
| 131 | TrCel7A-P390C |
| 132 | TrCel7A-P390G |
| 133 | TrCel7A-P390K |
| 134 | TrCel7A-P390L |
| 135 | TrCel7A-P390V |
| 136 | TrCel7A-P390W |
| 137 | TrCel7A-V393A |
| 138 | TrCel7A-S398P |
| 139 | TrCel7A-S400G |
| 140 | TrCel7A-Q406P |
| 141 | TrCel7A-V407I |
| 142 | TrCel7A-S419F |
| 143 | TrCel7A-N420D |

TABLE 3-continued

Isolated Cellobiohydrolases derived from TrCel7A

| SEQ ID NO: | Isolated CBH |
|---|---|
| 144 | TrCel7A-F423Y |
| 145 | TrCel7A-G430D |
| 146 | TrCel7A-N431R |
| 147 | TrCel7A-G435S |
| 148 | TrCel7A-N436D |
| 149 | TrCel7A-P437T |
| 150 | TrCel7A-N441D |
| 151 | TrCel7A-G444D |
| 152 | TrCel7A-T445I |
| 153 | TrCel7A-T446A |
| 154 | TrCel7A-T447S |
| 155 | TrCel7A-R450S |
| 156 | TrCel7A-T453I |
| 157 | TrCel7A-T453S |
| 158 | TrCel7A-T454I |
| 159 | TrCel7A-T455Q |
| 160 | TrCel7A-P459L |
| 161 | TrCel7A-Q463K |
| 162 | TrCel7A-Q463L |
| 163 | TrCel7A-Q463S |
| 164 | TrCel7A-Y466S |
| 165 | TrCel7A-G467D |
| 166 | TrCel7A-G471S |
| 167 | TrCel7A-S475N |
| 168 | TrCel7A-G476D |
| 169 | TrCel7A-S482N |
| 170 | TrCel7A-G483S |
| 171 | TrCel7A-G483V |
| 172 | TrCel7A-C486R |
| 173 | TrCel7A-V488D |
| 174 | TrCel7A-L489P |
| 175 | TrCel7A-L489Q |
| 176 | TrCel7A-P13T-N184S |
| 177 | TrCel7A-T26A-P265T |
| 178 | TrCel7A-T26S-I237T |
| 179 | TrCel7A-N45D-D52R |
| 180 | TrCel7A-N45D-G339D |
| 181 | TrCel7A-N54I-G471S |
| 182 | TrCel7A-N54S-D130E |
| 183 | TrCel7A-I93V-V131A |
| 184 | TrCel7A-K102R-D130N |
| 185 | TrCel7A-L108I-N436D |
| 186 | TrCel7A-M111T-G435S |
| 187 | TrCel7A-P137S-K353M |
| 188 | TrCel7A-V155M-C486R |
| 189 | TrCel7A-I183N-T447S |
| 190 | TrCel7A-Q186K-Q351R |
| 191 | TrCel7A-G253R-Q463S |
| 192 | TrCel7A-G260D-N327Y |
| 193 | TrCel7A-T281A-T454I |
| 194 | TrCel7A-K286E-S379E |
| 195 | TrCel7A-T332I-M364V |
| 196 | TrCel7A-G358S-P390C |
| 197 | TrCel7A-A372T-V393A |
| 198 | TrCel7A-R450S-S482N |
| 199 | TrCel7A-P13H-G358S-M364V |
| 200 | TrCel7A-D114E-D150N-T453S |
| 201 | TrCel7A-S211T-Q463L-V488D |
| 202 | TrCel7A-T281I-T455Q-Q463K |
| 203 | TrCel7A-N373Y-V407I-P459L |
| 204 | TrCel7A-N420D-G444D-L489P |
| 205 | TrCel7A-S46A-E193G-F311L-T383S |
| 206 | TrCel7A-T5I-T26A-E325K-T356I |
| 207 | TrCel7A-C209S-P265T-D378E-T445I |
| 208 | TrCel7A-M213I-Q406P-F423Y-T446A |
| 209 | TrCel7A-A316V-T383A-P437T-G467D |
| 210 | TrCel7A-N441D-T453I-G483S-L489Q |
| 211 | TrCel7A-R39L-N54S-G88V-F129S-T246S-T271I-N324D-S398P |
| 212 | TrCel7A-G483V-stop498Y |
| 213 | TrCel7A-T59A-S156G-C486stop |
| 214 | TrCel7A-G75S-S400G-C486stop |
| 215 | TrCel7A-P194Q-T478ins |
| 216 | TrCel7A-N197A-Q468stop |
| 217 | TrCel7A-D249N-Q487frame |

Isolated cellobiohydrolases of the present invention comprising a modified Family 7 catalytic domain and/or a modified Family 1 CBM derived from any of the fungal cellobiohydrolases in Table 1 or Table 2 may be developed by aligning the amino acid sequence of a parental fungal cellobiohydrolase with that of T. reesei Cel7A and identifying the equivalent amino acids in the parental fungal cellobiohydrolase to positions 26, 39, 45, 46, 51, 52, 53, 54, 75, 87, 93, 95, 102, 111, 114, 129, 130, 131, 138, 139, 143, 144, 150, 155, 156, 181, 183, 184, 197, 209, 211, 219, 237, 241, 253, 260, 264, 271, 282, 314, 316, 324, 326, 339, 343, 351, 353, 358, 364, 368, 370, 373, 374, 375, 378, 379, 382, 383, 385, 390, 398, 400, 406, 419, 420, 423, 435, 436, 437, 441, 444, 446, 447, 450, 453, 454, 455, 459, 463, 466, G467, 471, 475, 476, 482, 483, 486, 488, and/or 489 and making the equivalent amino acid substitutions. For example, an isolated cellobiohydrolase may be derived from *Myceliophthora thermophila* MtCel7A cellobiohydrolase by aligning SEQ ID NO: 2 with SEQ ID NO: 1, as shown in FIG. 4, to identify in SEQ ID NO: 2 the equivalents of positions 26, 39, 45, 46, 51, 52, 53, 54, 75, 87, 93, 95, 102, 111, 114, 129, 130, 131, 138, 139, 143, 144, 150, 155, 156, 181, 183, 184, 197, 209, 211, 219, 237, 241, 253, 260, 264 271, 282, 314, 316, 324, 326, 339, 343, 351, 353, 358, 364, 368, 370, 373, 374, 375, 378, 379, 382, 383, 385, 390, 398, 400, 406, 419, 420, 423, 435, 436, 437, 441, 444, 446, 447, 450, 453, 454, 455, 459, 463, 466, 467, 471, 475, 476, 482, 483, 486, 488, and 489 of SEQ ID NO: 1. The result would be an isolated *Myceliophthora thermophila* MtCel7A cellobiohydrolase comprising one or more amino acid substitution selected from the group consisting of: T26X, R39X, S46X, Y51X, E52X, G53X, N54X, G75X, S87X, L93X, F95X, Y101X, T103X, M112X, D115X, F130X, D131X, V132X, C139X, G140X, A144X, L145X, D151X, S157X, K182X, I184X, N185X, Q194X, N198X, C210X, S212X, N220X, R238X, D242X, A254X, G261X, N265X, K272X, V281X, S318X, S320X, N328X, S329X, I330X, G343X, F348X, Q356X, G358X, G363X, M369X, D373X, N378X, M379X, L380X, D383X, S384X, P387X, I388X, D389X, P394X, T404X, E410X, S423X, N424X, F427X, V434X, G441X, S442X, G443X, N446X, V449X, S451X, V455X, S459X, Y478X, E479X, G483X, T487X, G488X, S494X, C498X, K500X, and L501X and exhibiting from about 75% to about 99.9% amino acid sequence identity to amino acids 1-509 of SEQ ID NO: 2.

A list of isolated MtCel7A cellobiohydrolase enzymes in accordance with the present invention, which is not to be considered limiting in any manner, is presented in Table 4.

TABLE 4

Isolated Cellobiohydrolases derived from MtCel7A

| SEQ ID NO: | Isolated CBH |
|---|---|
| 218 | MtCel7A-S13H |
| 219 | MtCel7A-S13T |
| 220 | MtCel7A-G22D |
| 221 | MtCel7A-T26A |
| 222 | MtCel7A-T26S |
| 223 | MtCel7A-S27L |
| 224 | MtCel7A-R39L |
| 225 | MtCel7A-S46A |
| 226 | MtCel7A-S46G |
| 227 | MtCel7A-S46L |
| 228 | MtCel7A-S46T |
| 229 | MtCel7A-Y51I |
| 230 | MtCel7A-E52R |
| 231 | MtCel7A-E52T |
| 232 | MtCel7A-E52W |
| 233 | MtCel7A-G53A |

TABLE 4-continued

Isolated Cellobiohydrolases derived from MtCel7A

| SEQ ID NO: | Isolated CBH |
|---|---|
| 234 | MtCel7A-G53M |
| 235 | MtCel7A-G53R |
| 236 | MtCel7A-G53W |
| 237 | MtCel7A-N54D |
| 238 | MtCel7A-N54I |
| 239 | MtCel7A-N54S |
| 240 | MtCel7A-S59A |
| 241 | MtCel7A-G75S |
| 242 | MtCel7A-S87T |
| 243 | MtCel7A-G88V |
| 244 | MtCel7A-L93V |
| 245 | MtCel7A-F95L |
| 246 | MtCel7A-F95Y |
| 247 | MtCel7A-Y101G |
| 248 | MtCel7A-Y101L |
| 249 | MtCel7A-Y101T |
| 250 | MtCel7A-Y101V |
| 251 | MtCel7A-Y101W |
| 252 | MtCel7A-T103R |
| 253 | MtCel7A-T103S |
| 254 | MtCel7A-T109I |
| 255 | MtCel7A-M112T |
| 256 | MtCel7A-D115E |
| 257 | MtCel7A-F130S |
| 258 | MtCel7A-D131E |
| 259 | MtCel7A-D131N |
| 260 | MtCel7A-V132A |
| 261 | MtCel7A-G138S |
| 262 | MtCel7A-C139S |
| 263 | MtCel7A-G140E |
| 264 | MtCel7A-G140M |
| 265 | MtCel7A-G140Q |
| 266 | MtCel7A-G140R |
| 267 | MtCel7A-G140S |
| 268 | MtCel7A-A144G |
| 269 | MtCel7A-A144L |
| 270 | MtCel7A-L145A |
| 271 | MtCel7A-L145V |
| 272 | MtCel7A-D151N |
| 273 | MtCel7A-S157G |
| 274 | MtCel7A-K182L |
| 275 | MtCel7A-I184N |
| 276 | MtCel7A-N185S |
| 277 | MtCel7A-E187K |
| 278 | MtCel7A-Q194G |
| 279 | MtCel7A-S195Q |
| 280 | MtCel7A-N198A |
| 281 | MtCel7A-N198L |
| 282 | MtCel7A-N198Q |
| 283 | MtCel7A-N198V |
| 284 | MtCel7A-N198W |
| 285 | MtCel7A-N201C |
| 286 | MtCel7A-N201F |
| 287 | MtCel7A-C210S |
| 288 | MtCel7A-S212T |
| 289 | MtCel7A-M214I |
| 290 | MtCel7A-N220S |
| 291 | MtCel7A-R238T |
| 292 | MtCel7A-D242L |
| 293 | MtCel7A-D242R |
| 294 | MtCel7A-D242V |
| 295 | MtCel7A-T247S |
| 296 | MtCel7A-T250C |
| 297 | MtCel7A-T250N |
| 298 | MtCel7A-A254D |
| 299 | MtCel7A-A254R |
| 300 | MtCel7A-G261D |
| 301 | MtCel7A-N265C |
| 302 | MtCel7A-N265Y |
| 303 | MtCel7A-S266T |
| 304 | MtCel7A-K272I |
| 305 | MtCel7A-T280A |
| 306 | MtCel7A-T280I |
| 307 | MtCel7A-K285E |
| 308 | MtCel7A-A298T |
| 309 | MtCel7A-I315L |
| 310 | MtCel7A-S318A |
| 311 | MtCel7A-S320V |
| 312 | MtCel7A-N328D |
| 313 | MtCel7A-S329K |
| 314 | MtCel7A-I330F |
| 315 | MtCel7A-T331Y |
| 316 | MtCel7A-D336I |
| 317 | MtCel7A-G343D |
| 318 | MtCel7A-F348L |
| 319 | MtCel7A-Q356R |
| 320 | MtCel7A-G358M |
| 321 | MtCel7A-L361A |
| 322 | MtCel7A-L361I |
| 323 | MtCel7A-G363S |
| 324 | MtCel7A-M369V |
| 325 | MtCel7A-D373A |
| 326 | MtCel7A-D373G |
| 327 | MtCel7A-V377T |
| 328 | MtCel7A-N378Y |
| 329 | MtCel7A-M379V |
| 330 | MtCel7A-L380A |
| 331 | MtCel7A-D383E |
| 332 | MtCel7A-S384C |
| 333 | MtCel7A-S384E |
| 334 | MtCel7A-P387I |
| 335 | MtCel7A-P387L |
| 336 | MtCel7A-P387Q |
| 337 | MtCel7A-I388A |
| 338 | MtCel7A-I388S |
| 339 | MtCel7A-G390I |
| 340 | MtCel7A-G390L |
| 341 | MtCel7A-P394A |
| 342 | MtCel7A-P394C |
| 343 | MtCel7A-P394G |
| 344 | MtCel7A-P394K |
| 345 | MtCel7A-P394L |
| 346 | MtCel7A-P394V |
| 347 | MtCel7A-P394W |
| 348 | MtCel7A-E397A |
| 349 | MtCel7A-T404G |
| 350 | MtCel7A-E410P |
| 351 | MtCel7A-V411I |
| 352 | MtCel7A-S423F |
| 353 | MtCel7A-N424D |
| 354 | MtCel7A-F427Y |
| 355 | MtCel7A-V434D |
| 356 | MtCel7A-S435R |
| 357 | MtCel7A-G441S |
| 358 | MtCel7A-S442D |
| 359 | MtCel7A-G443T |
| 360 | MtCel7A-N446D |
| 361 | MtCel7A-V449D |
| 362 | MtCel7A-S450I |
| 363 | MtCel7A-S451A |
| 364 | MtCel7A-V455S |
| 365 | MtCel7A-S458I |
| 366 | MtCel7A-S459I |
| 367 | MtCel7A-T460Q |
| 368 | MtCel7A-S466L |
| 369 | MtCel7A-A475K |
| 370 | MtCel7A-A475L |
| 371 | MtCel7A-A475S |
| 372 | MtCel7A-Y478S |
| 373 | MtCel7A-E479D |
| 374 | MtCel7A-G483S |
| 375 | MtCel7A-T487N |
| 376 | MtCel7A-G488D |
| 377 | MtCel7A-S494N |
| 378 | MtCel7A-P495S |
| 379 | MtCel7A-P495V |
| 380 | MtCel7A-C498R |
| 381 | MtCel7A-K500D |
| 382 | MtCel7A-L501P |
| 383 | MtCel7A-L501Q |

Isolated Cellobiohydrolases with Improved Activity Against Process Substrates

The isolated cellobiohydrolase of the present invention, as described above, may exhibit increased specific activity, reduced inhibition by glucose, reduced inactivation by lignin, increased activity in the presence of lignin, increased activity in the presence of lignocellulose hydrolysate, or any combination thereof, relative to a cellobiohydrolase comprising a parental Family 7 catalytic domain from which the modified Family 7 catalytic domain is derived.

By increased specific activity, it is meant that for a given amount of isolated cellobiohydrolase (comprising a modified Family 7 catalytic domain or comprising a parental or modified Family 7 catalytic domain and a modified Family 1 CBM) acting upon a cellulosic substrate for a given amount of time, more cellulosic substrate is converted to product than would be converted by a corresponding cellobiohydrolase (comprising a parental Family 7 catalytic domain or comprising both a parental Family 7 catalytic domain and a parental Family 1 CBM) under substantially equivalent reaction conditions. The amount of cellobiohydrolase acting upon the cellulosic substrate may be measured in mass or moles of protein per volume of hydrolysis reaction, mass or moles of protein per weight of hydrolysis reaction, mass or moles of protein per mass of cellulose or cellulosic substrate and other measures known to one of skill in the art.

For the purposes herein, a cellulosic substrate includes, but is not limited to, crystalline or insoluble cellulose, amorphous cellulose (e.g., phosphoric-acid swollen cellulose), cellulose-containing biomass (including, but not limited to, lignocellulosic substrates such as straws, grasses, wood, wood pulp), paper and paper products, cotton and cellulose-containing textiles, soluble cellulose derivatives (e.g., carboxymethyl- or hydroxylethyl-cellulose, a.k.a., CMC and HEC), dyed cellulose (e.g., azo-CMC), as well as low molecular weight cellulose derivatives such as cello-oligosaccharides, fluorogenic substrates such as methyl umbelliferyl-beta-D-cellobioside (MUC) or methyl umbelliferyl-beta-D-lactoside (MUL), or colorimetric substrates such as p-nitrophenyl beta-D-cellobioside (pNP-G2) or p-nitrophenyl beta-D-lactoside (pNP-lac).

The conversion of cellulosic substrates to products may be determined by any number of methods known to one of skill in the art. For example, hydrolysis of cellulose or cellulose derivatives can be monitored by measuring the enzyme-dependent release of reducing sugars, which are quantified in subsequent chemical or chemienzymatic assays known to one of skill in the art, including reaction with dinitrosalisylic acid (DNS). Hydrolysis of polysaccharides can also be monitored by chromatographic methods that separate and quantify soluble mono-, di- and oligo-saccharides released by the enzyme activity. In addition, soluble colorimetric and low molecular weight cellulose derivatives may be incorporated into agar-medium on which a host microbe expressing and secreting an isolated cellobiohydrolase is grown. In such an agar-plate assay, activity of the cellobiohydrolase is detected as a colored or colorless halo around the individual microbial colony expressing and secreting an active cellulase. The practice of the present invention is not limited by the method used to assess the activity of the isolated cellobiohydrolase.

By reduced inhibition by glucose, it is meant that for a given amount of isolated cellobiohydrolase (comprising a modified Family 7 catalytic domain or comprising a parental or modified Family 7 catalytic domain and a modified Family 1 CBM) acting upon a cellulosic substrate for a given amount of time in the presence of inhibitory levels of glucose, more cellulosic substrate is converted to products than would be converted by a corresponding cellobiohydrolase (comprising a parental Family 7 catalytic domain or comprising both a parental Family 7 catalytic domain and a parental Family 1 CBM) under substantially identical reaction conditions. Glucose inhibition of cellulases may also be measured by determination of the inhibition constant $K_G$, defined as the concentration of glucose which reduces the activity of the cellulase by 50%. The value of $K_G$ is not dependent on the nature of product inhibition—i.e., competitive, non-competitive or mixed-type. Isolated cellobiohydrolases that are less inhibited by glucose will have a higher value for $K_G$—i.e., a higher concentration of glucose is required to reduce the enzyme activity by 50%.

By reduced inactivation by lignin, it is meant it is meant that for a given amount of isolated cellobiohydrolase (comprising a modified Family 7 catalytic domain or comprising a parental or modified Family 7 catalytic domain and a modified Family 1 CBM) acting upon a cellulosic substrate for a given amount of time after prior exposure to or pre-incubation with lignin, more substrate is converted to products than would be converted by a corresponding cellobiohydrolase (comprising a parental Family 7 catalytic domain or comprising both a parental Family 7 catalytic domain and a parental Family 1 CBM) under substantially identical conditions. For example, the inactivation of a cellobiohydrolase by lignin may be determined by measuring the extent of cellulose conversion, as described above, in equivalent hydrolysis reactions, wherein one of the reactions contains a sufficient amount of lignin to reduce the cellulase activity. Alternatively, purified lignin may be treated to be less inactivating by coating with a non-specific protein such as BSA, a surfactant or other chemical and then added to a reaction of the cellobiohydrolase with a cellulosic substrate in the same amounts as untreated lignin.

By increased activity in the presence of lignin, it is meant that an isolated cellobiohydrolase (comprising a modified Family 7 catalytic domain or comprising a parental or modified Family 7 catalytic domain and a modified Family 1 CBM) produces more product from a cellulosic substrate in the presence of lignin than does a corresponding cellobiohydrolase (comprising a parental Family 7 catalytic domain or comprising both a parental Family 7 catalytic domain and a parental Family 1 CBM) under substantially equivalent reaction conditions. The increased activity in the presence of lignin of an isolated cellobiohydrolase may be determined by measuring the conversion of cellulosic substrate in the presence and absence of lignin and then taking the ratio of the extent of conversion of cellulosic substrate in the presence of lignin to that in the absence of lignin. The increased activity may result from any one or more of reduced inhibition, inactivation or binding of the isolated cellobiohydrolase by lignin. The practice of the present invention is not limited by the mechanism(s) by which the isolated cellobiohydrolase exhibits increased activity in the presence of lignin.

The lignin present in such a cellulose hydrolysis reaction can be part of the insoluble substrate, such as in pre-treated lignocellulose, or be purified in a soluble or insoluble form. If the lignin is not part of the cellulosic substrate, such lignin may be treated to be less inactivating by coating with a non-specific protein such as BSA, a surfactant or other chemical and then added to a reaction of the cellobiohydrolase with a cellulosic substrate in the same amounts as untreated lignin. If the lignin is part of the insoluble substrate, one may also measure the ratio of the extent of conversion of an unbleached, lignin-containing cellulosic substrate to that of a bleached substrate (from which the lignin has been removed, for example, by an oxidant such as chlorine dioxide). An isolated cellobiohydrolase (comprising a modified Family 7 catalytic domain or comprising a parental or modified Family 7 catalytic domain and a modified Family 1 CBM) with increased activity in the presence of lignin will show a higher the ratio of the extent of conversion of an unbleached, lignin-containing cellulosic substrate to that of a bleached substrate than a corresponding cellobiohydrolase (comprising a parental Family 7 catalytic domain or comprising both a parental Family 7 catalytic domain and a parental Family 1 CBM).

One of skill in the art recognizes that isolated cellobiohydrolases with reduced inactivation by lignin or increased activity in the presence of lignin may exhibit reduced binding to lignin. Binding to lignin may be assessed by determine the lignin-binding constant ($K_L$) as described in U.S. Publication No. 2010/0041100. Isolated cellobiohydrolases (comprising a modified Family 7 catalytic domain or comprising a parental or modified Family 7 catalytic domain and a modified Family 1 CBM) exhibiting reduced binding to lignin will have an increased $K_L$ relative to that of a corresponding cellobiohydrolase (comprising a parental Family 7 catalytic domain or comprising both a parental Family 7 catalytic domain and a parental Family 1 CBM).

By increased activity in the presence of lignocellulose hydrolysate it is meant that for a given amount of an isolated cellobiohydrolase (comprising a modified Family 7 catalytic domain or comprising a parental or modified Family 7 catalytic domain and a modified Family 1 CBM) more product is produced from a cellulosic substrate in the presence of lignocellulose hydrolysate than from a corresponding cellobiohydrolase (comprising a parental Family 7 catalytic domain or comprising both a parental Family 7 catalytic domain and a parental Family 1 CBM) under substantially equivalent reaction conditions. Increased activity in the presence of lignocellulose hydrolysate may be determined by measuring the conversion of cellulosic substrate in the presence and absence of the hydrolysate and then taking the ratio of the extent of conversion of cellulosic substrate in the presence of hydrolysate to that in the absence of hydrolysate. By lignocellulose hydrolysate, it is meant a cocktail of one or more of pentose and hexose sugars, lignin monomers, organic acids and sugar break-down produces such as furfural or hydroxymethylfurfural, produced by the chemical or enzymatic treatment of lignocellulosic biomass, by using methods known by one of skill in the art. As such, the increased activity in the presence of lignocellulose hydrolysate may be determined by comparing the extent of conversion of the cellulose in such pretreated lignocellulosic substrate in the presence of hydrolysate (e.g., "unwashed" pretreated substrate or a mixture of washed substrate and hydrolysate) and the absence or hydrolysate (e.g., of a "washed" pretreated substrate).

The increased activity in the presence of lignocellulose hydrolysate may result from reduced inhibition and/or inactivation of the isolated cellobiohydrolase by lignocellulose hydrolysate. The practice of the present invention is not limited by the mechanism(s) by which the isolated cellobiohydrolase exhibits increased activity in the presence of lignocellulose hydrolysate.

Genetic Constructs Encoding Isolated Cellobiohydrolases

The present invention also relates to genetic constructs comprising a polynucleotide sequence encoding an isolated cellobiohydrolase operably linked to regulatory polynucleotide sequences directing the expression and secretion of the isolated cellobiohydrolase from a host microbe. As used herein, "genetic construct" refers to an isolated polynucleotide comprising elements directing the expression of the isolated cellobiohydrolase. These elements may include, but are not limited to, a coding region comprising a polynucleotide sequence that encodes the isolated cellobiohydrolase, a promoter operably linked to the coding region and comprising a polynucleotide sequence that directs the transcription of the coding region, and a sequence encoding a secretion signal peptide and operably linked to the coding region, or targeting polynucleotide sequences that direct homologous recombination of the construct into the genome of the host microbe.

The terms "secretion signal peptide", "secretion signal" and "signal peptide" refer to any sequence of nucleotides and/or amino acids which may participate in the secretion of the mature or precursor forms of a secreted protein. The signal sequence may be endogenous or exogenous with respect to the host microbe. The signal sequence may be that normally associated with the protein of interest, from a gene encoding another secreted protein, or be a "hybrid signal sequence" encoded by partial sequences from two or more genes encoding secreted proteins.

As understood by one of ordinary skill in the art, the promoter and sequence encoding a secretion signal peptide may be derived from the host microbe or from a different organism, and/or be synthesized in vitro. For example, the promoter and sequence encoding a secretion signal peptide may be derived from one or more genes encoding proteins that are highly expressed and secreted when the host microbe, such as gene encoding a cellulase, beta-glucosidase, cellulase-enhancing protein, a hemicellulase or any combination thereof. However, it should be understood that the practice of the present invention is not limited by the choice of promoter or sequence encoding a secretion signal peptide in the genetic constructs. These polynucleotide elements may also be altered or engineered by replacement, substitution, addition, or elimination of one or more nucleic acids relative to a naturally-occurring polynucleotide. The practice of this invention is not constrained by such alterations to elements comprising the genetic construct A genetic construct may contain a selectable marker for determining transformation of a host microbe. The selectable marker may be present on the genetic construct or the selectable marker may be a separate isolated polynucleotide that is co-transformed with the genetic construct. Choices of selectable markers are well known to those skilled in the art and include genes (synthetic or natural) that confer to the transformed cells the ability to utilize a metabolite that is not normally metabolized by the microbe (e.g., the *A. nidulans* amdS gene encoding acetamidase and conferring the ability to grow on acetamide as the sole nitrogen source) or antibiotic resistance (e.g., the *Escherichia coli* hph gene encoding hygromycin-beta-phosphotransferase and conferring resistance to hygromycin). If the host strain expresses little or none of the chosen marker activity, then the corresponding gene may be used as a marker. Examples of such markers include trp, pyr4, pyrG, argB, leu, and the like. The corresponding host microbe would therefore have to be lacking a functional gene corresponding to the marker chosen, i.e., lacking in the expression of trp, pyr, arg, leu and the like.

A genetic construct may contain a transcriptional terminator that is functional in the host microbe, as would be known to one of skill in the art. The transcriptional terminator may be positioned immediately downstream of a coding region. The practice of the invention is not constrained by the choice of transcriptional terminator that is sufficient to direct the termination of transcription in the host microbe.

A genetic construct may contain additional polynucleotide sequences between the various sequence elements as described herein. These sequences, which may be natural or synthetic, may result in the addition of one or more amino acids to the isolated cellobiohydrolase encoded by the construct. The practice of the invention is not constrained by the presence of additional polynucleotide sequences between the various sequence elements of the genetic constructs present in the host microbe.

Methods of introducing a genetic construct into a host microbe are familiar to those skilled in the art and include, but are not limited to, calcium chloride treatment of microbial cells or fungal protoplasts to weaken the cell membranes, addition of polyethylene glycol to allow for fusion of cell membranes, depolarization of cell membranes by electroporation, or shooting the construct through the cell wall and membranes via microprojectile bombardment with a particle gun. The practice of the present invention is not constrained by the method of introducing the genetic constructs into the fungal cell.

Genetically Modified Microbes Expressing Isolated Cellobiohydrolases

The isolated cellobiohydrolase may be expressed and secreted from a genetically modified microbe produced by transformation of a host microbe with a genetic construct encoding the isolated cellobiohydrolase. The host microbe may be a yeast or a filamentous fungus, particularly those classified as Ascomycota. Genera of yeasts useful as host microbes for the expression of isolated cellobiohydrolases of the present invention include *Saccharomyces, Pichia, Hansenula, Kluyveromyces, Yarrowia*, and *Arxula*. Genera of fungi useful as microbes for the expression of isolated cellobiohydrolases of the present invention include *Trichoderma, Hypocrea, Aspergillus, Fusarium, Humicola, Neurospora, Chrysosporium, Myceliophthora, Thielavia, Sporotrichum* and *Penicillium*. For example, the host microbe may be an industrial strain of *Trichoderma reesei* or *Myceliophthora thermophila*.

The genetic construct may be introduced into the host microbe by any number of methods known by one skilled in the art of microbial transformation, including but not limited to, treatment of cells with $CaCl_2$, electroporation, biolistic bombardment, PEG-mediated fusion of protoplasts (e.g. White et al., WO 2005/093072, which is incorporated herein by reference). After selecting the recombinant fungal strains expressing the isolated cellobiohydrolase, the selected recombinant strains may be cultured in submerged liquid fermentations under conditions that induce the expression of the isolated cellobiohydrolase.

Production of Isolated Cellobiohydrolases

The isolated cellobiohydrolase of the present invention may be produced in a fermentation process in which a genetically modified microbe comprising a genetic construct encoding the isolated cellobiohydrolase is grown in submerged liquid culture fermentation.

Submerged liquid fermentations of microorganisms, including industrial strains of *Trichoderma, Myceliophthora* and taxonomically equivalent genera, are typically conducted as a batch, fed-batch or continuous process. In a batch process, all the necessary materials, with the exception of oxygen for aerobic processes, are placed in a reactor at the start of the operation and the fermentation is allowed to proceed until completion, at which point the product is harvested. A batch process for producing the isolated cellobiohydrolase of the present invention may be carried out in a shake-flask or a bioreactor.

In a fed-batch process, the culture is fed continuously or sequentially with one or more media components without the removal of the culture fluid. In a continuous process, fresh medium is supplied and culture fluid is removed continuously at volumetrically equal rates to maintain the culture at a steady growth rate.

One of skill in the art is aware that fermentation medium comprises a carbon source, a nitrogen source, and other nutrients, vitamins and minerals which can be added to the fermentation media to improve growth and enzyme production of the host cell. These other media components may be added prior to, simultaneously with or after inoculation of the culture with the host cell.

For the process for producing the isolated cellobiohydrolase of the present invention, the carbon source may comprise a carbohydrate that will induce the expression of the isolated cellobiohydrolase from a genetic construct in the genetically modified microbe. For example, if the genetically modified microbe is a strain of a cellulolytic fungus such as *Trichoderma* or *Myceliophthora*, the carbon source may comprise one or more of cellulose, cellobiose, sophorose, xylan, xylose, xylobiose and related mono-, di-, oligo- or polysaccharides known to induce expression of cellulases and beta-glucosidase in such cellulolytic fungi.

In the case of batch fermentation, the carbon source may be added to the fermentation medium prior to or simultaneously with inoculation. In the cases of fed-batch or continuous operations, the carbon source may also be supplied continuously or intermittently during the fermentation process. For example, when the genetically modified microbe is a strain of *Trichoderma* or *Myceliophthora*, the carbon feed rate is between 0.2 and 4 g carbon/L of culture/h, or any amount therebetween.

The process for producing the isolated cellobiohydrolase of the present invention may be carried at a temperature from about 20° C. to about 50° C., or any temperature therebetween, for example from about 25° C. to about 37° C., or any temperature therebetween, or from 20, 22, 25, 26, 27, 28, 29, 30, 32, 35, 37, 40, 45, 50° C. or any temperature therebetween.

The process for producing the isolated cellobiohydrolase of the present invention may be carried out at a pH from about 3.0 to 8.5, or any pH therebetween, for example from about pH 3.5 to pH 7.0, or any pH therebetween, for example from about pH 3.0, 3.2, 3.4, 3.5, 3.7, 3.8, 4.0, 4.1, 4.2, 4.3, 4.4, 4.5, 4.6, 4.7, 4.8, 4.9, 5.0, 5.2, 5.4, 5.5, 5.7, 5.8, 6.0, 6.2, 6.5, 7.0, 7.5, 8.0, 8.5 or any pH therebetween.

Following fermentation, the fermentation broth containing the isolated cellobiohydrolase may be used directly, or the isolated cellobiohydrolase may be separated from the fungal cells, for example by filtration or centrifugation. Low molecular solutes such as unconsumed components of the fermentation medium may be removed by ultrafiltration. The isolated cellobiohydrolase may be concentrated, for example, by evaporation, precipitation, sedimentation or filtration. Chemicals such as glycerol, sucrose, sorbitol and the like may be added to stabilize the isolated cellobiohydrolase. Other chemicals, such as sodium benzoate or potassium sorbate, may be added to the isolated cellobiohydrolase to prevent growth of microbial contamination.

The isolated cellobiohydrolase of the present invention may also be produced by genetically modified microbe comprising a genetic construct encoding the isolated cellobiohydrolase growing on a semi-solid medium, e.g., agar, containing a carbon source that induces the expression of the isolated cellobiohydrolase. For example, the genetically modified microbe may be grown on an agar medium containing a cellulosic substrate, as defined above.

Cellulase Mixtures Comprising Isolated Cellobiohydrolases

The isolated cellobiohydrolase may be part of a cellulase mixture. As used herein, a cellulase mixture is a preparation comprising the isolated cellobiohydrolase in combination with one or more cellobiohydrolase, endoglucanase, beta-glucosidase, hemicellulase, cellulase-enhancing protein, lignin-degrading enzyme, esterase, protease, pectinases, pectate lyases, galactanases, amylases, glucoamylases, glucuronidases or galacturonidases. The practice of the present invention is not limited by the composition of the cellulase enzyme mixture.

The following definitions refer to classification of cellobiohydrolases, endoglucanases, beta-glucosidases, hemicellulases and related proteins as defined by the by the Joint Commission on Biochemical Nomenclature of the International Union of Biochemistry and Molecular Biology (Published in Enzyme Nomenclature 1992, Academic Press, San Diego, Calif., ISBN 0-12-227164-5; with supplements in *Eur. J. Biochem.* 1994, 223, 1-5; *Eur. J. Biochem.* 1995, 232, 1-6; *Eur. J. Biochem.* 1996, 237, 1-5; *Eur. J. Biochem.* 1997, 250; 1-6, and *Eur. J. Biochem.* 1999, 264, 610-650, each of which are incorporated herein by reference; also see: chem.qmul.ac.uk/iubmb/enzyme/) and to the glycoside hydrolase (GH) families as defined by the CAZy system which is accepted as a standard nomenclature for glycohydrolase enzymes (Coutinho, P. M. & Henrissat, B., 1999, "Carbon-active enzymes: an integrated database approach." In *Recent Advances in Carbon Bioengineering*, H. J. Gilbert, G. Davies, B. Henrissat and B. Svensson eds., The Royal Society of Chemistry, Cambridge, pp. 3-12, which is incorporated herein by reference; also see: afmb.cnrs-mrs.fr/CAZY/) and is familiar to those skilled in the art.

The term cellulase (or cellulase enzymes) broadly refers to enzymes that catalyze the hydrolysis of the β-1,4-glucosidic bonds joining individual glucose units in the cellulose polymer. The catalytic mechanism involves the synergistic actions of endoglucanases (E.C. 3.2.1.4) and cellobiohydrolases (E.C. 3.2.1.91). Endoglucanases hydrolyze accessible glycosidic bonds in the middle of the cellulose chain, while cellobiohydrolases release cellobiose from these chain ends processively. Cellobiohydrolases are also referred to as exoglucanases. Most cellulases have a similar modular structure, which consists of one or more catalytic domain and one or more carbohydrate-binding modules (CBM) joined by flexible linker peptides. Most cellulases comprise at least one catalytic domain of GH Family 5, 6, 7, 8, 9, 12, 44, 45, 48, 51, 61 and 74.

A cellulase-enhancing protein is a protein that enhances the rate or extent of cellulose hydrolysis by cellulase enzymes but does not exhibit significant cellulose-degrading activity on its own. Cellulase-enhancing proteins include, but are not limited to, proteins classified in GH Family 61, swollenins and expansins.

A hemicellulase or hemicellulose degrading enzyme is an enzyme capable of hydrolysing the glycosidic bonds in a hemicellulose polymer. Hemicellulases include, but are not limited to, xylanase (E. C. 3.2.1.8), beta-mannanase (E.C. 3.2.1.78), alpha-arabinofuranosidase (E.C. 3.2.1.55), beta-xylosidases (E.C. 3.2.1.37), and beta-mannosidase (E.C. 3.2.1.25). Hemicellulases typically comprise a catalytic domain of Glycoside Hydrolase Family 5, 8, 10, 11, 26, 43, 51, 54, 62 or 113.

Beta-glucosidases (E.C. 3.2.1.21) hydrolyze cellobiose to glucose. Beta-glucosidases typically comprise catalytic domains of GH Family 1 or 3 but usually do not comprise a CBM.

Lignin degrading enzymes are enzymes that oxidize and participate in the depolymerisation of lignin and include, for example, laccases (E.C. 1.10.3.2), lignin peroxidases (E.C. 1.11.1.14), manganese peroxidases (E.C. 1.11.1.13) and cellobiose dehydrogenases (E.C. 1.1.99.18).

A cellulase enzyme mixture of the present invention may also include one or more esterases, including but not limited to acetyl xylan esterases (E.C. 3.1.1.72) and ferulic acid esterases (E.C. 3.1.1.73). The cellulase enzyme mixture may also include one or more additional enzyme activities such as pectinases, pectate lyases, galactanases, amylases, glucoamylases, glucuronidases and galacturonidases.

The practice of the fermentation process of the present invention is not limited by the particular composition of the cellulase enzyme mixture. However, depending on the intended use of the cellulase enzyme mixture produced, it may be desirable that the isolated cellobiohydrolase of the present invention comprise from about 10 wt % to about 100 wt %, for example about 10, 20, 30, 40, 50, 60, 70, 80, 90 or 100 wt %, or any wt % therebetween, of the protein present in the cellulase enzyme mixture.

In one embodiment of the invention, the isolated cellobiohydrolase is one of many proteins expressed from a host cell, including, but not limited to the cellulase mixture described above. The isolated cellobiohydrolase and other protein(s) in the cellulase enzyme mixtures may be secreted from a single genetically modified microbe or by different microbes in combined or separate fermentations. Similarly, the isolated cellobiohydrolase and other protein(s) in the cellulase enzyme mixture may be expressed individually or in sub-groups from different strains of different organisms and the enzymes combined to make the cellulase enzyme mixture. It is also contemplated that isolated cellobiohydrolase and other protein(s) in the cellulase enzyme mixture may be expressed individually or in sub-groups from different strains of a single organism, such as from different strains of *Saccharomyces, Pichia, Hansenula, Trichoderma, Hypocrea, Aspergillus, Fusarium, Humicola, Chrysosporium, Myceliophthora, Thielavia, Sporotrichum, Talaromyces, Neurospora*, or *Penicillium*, and the enzymes combined to make the cellulase enzyme mixture. Preferably, all of the enzymes are expressed from a single host organism, such as a strain of cellulolytic fungus belonging to a species of *Trichoderma, Hypocrea, Aspergillus, Fusarium, Humicola, Chrysosporium, Myceliophthora, Thielavia, Sporotrichum, Talaromyces, Neurospora* or *Penicillium*.

Hydrolysis of Cellulosic Substrates Using Isolated Cellobiohydrolases

The isolated cellobiohydrolase of the present invention may be used in the hydrolysis of a cellulosic substrate. By the term "cellulosic substrate", it is meant any substrate derived from plant biomass and comprising cellulose, including, but not limited to, crystalline or insoluble cellulose, amorphous cellulose (e.g., phosphoric-acid swollen cellulose), pretreated lignocellulosic feedstocks for the production of ethanol or other high value products, animal feeds, food products, forestry products, such as pulp, paper and wood chips, textiles products. amorphous cellulose (e.g., phosphoric-acid swollen cellulose), soluble cellulose derivatives (e.g., carboxymethyl- or hydroxylethyl-cellulose, a.k.a., CMC and HEC), dyed cellulose (e.g., azo-CMC), as well as low molecular weight cellulose derivatives such as cello-oligosaccharides, fluorogenic substrates such as methyl umbelliferyl-beta-D-cellobioside (MUC) or methyl umbelliferyl-beta-D-lactoside (MUL), or colorimetric substrates such as p-nitrophenyl beta-D-cellobioside (pNP-G2) or p-nitrophenyl beta-D-lactoside (pNP-lac).

In one embodiment, the isolated cellobiohydrolase may be used, alone or as part of a cellulase mixture, to produce fermentable sugars from a pretreated lignocellulosic feedstock A pretreated lignocellulosic feedstock, or pretreated lignocellulose, is a material of plant origin that, prior to pretreatment, contains 20-90% cellulose (dry wt), more preferably about 30-90% cellulose (dry wt), even more preferably 40-90% cellulose (dry wt), for example 20, 22, 24, 26, 28, 30, 32, 34, 36, 38, 40, 42, 44, 46, 48, 50, 55, 60, 65, 70, 75, 80, 85, 90% (dry wt), or any % (dry wt), therebetween, and at least 10% lignin (dry wt), more typically at least 12% (dry wt) and that has been subjected to physical, chemical or biological processes to make the fiber more accessible and/or receptive to the actions of cellulolytic enzymes.

One method of performing acid pretreatment of the feedstock is steam explosion using the process conditions set out in U.S. Pat. No. 4,461,648. Another method of pretreating the feedstock slurry involves continuous pretreatment, meaning that the lignocellulosic feedstock is pumped though a reactor continuously. Continuous acid pretreatment is familiar to those skilled in the art; see, for example, U.S. Pat. No. 5,536, 325; WO 2006/128304; and U.S. Pat. No. 4,237,226. Additional techniques known in the art may be used as required such as the process disclosed in U.S. Pat. No. 4,556,430.

The pretreatment may also be conducted with alkali. In contrast to acid pretreatment, pretreatment with alkali does not hydrolyze the hemicellulose component of the feedstock, but rather the alkali reacts with acidic groups present on the hemicellulose to open up the surface of the substrate. The addition of alkali may also alter the crystal structure of the cellulose so that it is more amenable to hydrolysis. Examples of alkali that may be used in the pretreatment include ammonia, ammonium hydroxide, potassium hydroxide, and sodium hydroxide. An example of a suitable alkali pretreatment is Ammonia Freeze Explosion, Ammonia Fiber Explosion or Ammonia Fiber Expansion ("AFEX" process) as described in U.S. Pat. Nos. 5,171,592; 5,037,663; 4,600,590; 6,106,888; 4,356,196; 5,939,544; 6,176,176; 5,037,663 and 5,171,592. The pretreatment is preferably not conducted with alkali that is insoluble in water, such as lime and magnesium hydroxide.

Yet a further non-limiting example of a pretreatment process for use in the present invention includes chemical treatment of the feedstock with organic solvents. Organic liquids in pretreatment systems are described by Converse et al. (U.S. Pat. No. 4,556,430; incorporated herein by reference), and such methods have the advantage that the low boiling point liquids easily can be recovered and reused. Other pretreatments, such as the Organosolv™ process, also use organic liquids (see U.S. Pat. No. 7,465,791, which is also incorporated herein by reference). Subjecting the feedstock to pressurized water may also be a suitable pretreatment method (see Weil et al. (1997) *Appl. Biochem. Biotechnol.* 68(1-2): 21-40, which is incorporated herein by reference).

The pretreated lignocellulosic feedstock may be processed after pretreatment by any of several steps, such as dilution with water, washing with water, buffering, filtration, or centrifugation, or a combination of these processes, prior to enzymatic hydrolysis, as is familiar to those skilled in the art. The pH of the pretreated feedstock slurry may be adjusted to a value that is amenable to the cellulase enzymes, which is typically between about 4 and about 8.

The pretreated lignocellulose is subjected to enzymatic hydrolysis with a cellulase enzyme mixture comprising the isolated cellobiohydrolase. By the term "enzymatic hydrolysis", it is meant a process by which cellulases and another glycosidase enzymes or mixtures act on polysaccharides, such as cellulose and hemicellulose, to convert all or a portion thereof to soluble sugars such as glucose, cellobiose, cellodextrins, xylose, arabinose, galactose, mannose or mixtures thereof. The soluble sugars may be predominantly cellobiose and glucose.

The enzymatic hydrolysis is carried out at a pH and temperature that is at or near the optimum for the cellulase enzymes mixture. For example, the enzymatic hydrolysis may be carried out at about 30° C. to about 75° C., or any temperature therebetween, for example a temperature of 30, 35, 40, 45, 50, 55, 60, 65, 70, 75° C., or any temperature therebetween, and a pH of about 3.5 to about 8.0, or any pH therebetween, for example a pH of 3.5, 4.0, 4.5, 5.0, 5.5, 6.0, 6.5, 7.0, 7.5, 8.0 or any pH therebetween.

The initial concentration of cellulose, prior to the start of enzymatic hydrolysis of the pretreated lignocellulose, is preferably about 0.01% (w/w) to about 20% (w/w), or any amount therebetween, for example 0.01, 0.05, 0.1, 0.5, 1, 2, 4, 6, 8, 10, 12, 14, 15, 18, 20% (w/w) or any amount therebetween. The combined dosage of all cellulase enzymes may be about 0.001 to about 100 mg protein per gram cellulose, or any amount therebetween, for example 0.001, 0.01, 0.1, 1, 5, 10, 15, 20, 25, 30, 40, 50, 60, 70, 80, 90, 100 mg protein per gram cellulose or any amount therebetween.

The enzymatic hydrolysis of the pretreated lignocellulose may be carried out for a time period of about 0.5 hours to about 200 hours, or any time therebetween, for example, the hydrolysis may be carried out for a period of 2 hours to 100 hours, or any time therebetween, or it may be carried out for 0.5, 1, 2, 5, 7, 10, 12, 14, 15, 20, 25, 30, 35, 40, 45, 50, 55, 60, 65, 70, 75, 80, 85, 90, 95, 100, 120, 140, 160, 180, 200 hours or any time therebetween.

It should be appreciated that the reaction conditions are not meant to limit the invention in any manner and may be adjusted as desired by those of skill in the art.

The enzymatic hydrolysis of the pretreated lignocellulose may be batch hydrolysis, continuous hydrolysis, or a combination thereof. The hydrolysis may be agitated, unmixed, or a combination thereof. The enzymatic hydrolysis is typically carried out in a hydrolysis reactor. The cellulase enzyme may be added to the pretreated lignocellulosic substrate prior to, during, or after the addition of the substrate to the hydrolysis reactor.

The above description is not intended to limit the claimed invention in any manner. Furthermore, the discussed combination of features might not be absolutely necessary for the inventive solution.

EXAMPLES

The present invention will be further illustrated in the following examples. However, it is to be understood that these examples are for illustrative purposes only and should not be used to limit the scope of the present invention in any manner.

Example 1 describes the strains and vectors used in the following examples. Example 2 describes the cloning of the TrCel7A gene and the preparation of site-saturation mutagenesis libraries of TrCel7A. Example 3 describes the preparation of random mutagenesis libraries of TrCel7A. Example 4 describes the transformation of *T. reesei* host strains with genetic constructs expressing isolated cellobiohydrolases in. Example 5 describes the expression of wild-type and isolated TrCel7A cellobiohydrolases from microcultures. Example 6 describes the sequencing of polynucleotides encoding isolated cellobiohydrolases. Examples 7 through 12 describe the high-throughput screening assays to identify isolated cellobiohydrolases with improved activity on process substrates.

Example 1

Strains and Vectors

*Escherichia coli* strain DH5α (F-φ80lacZΔM15 Δ(lac-ZYA-argF)U169 recA1 endA1 hsdR17(rk−, mk+) phoA supE44 thi-1 gyrA96 relA1λ−) was obtained from Invitrogen (cat. No. 18265-017 and/or 18258-012). *Trichoderma reesei* strain P297J, a proprietary strain of Iogen Corporation, is a derivative of *T. reesei* strain BTR213 from which the genes encoding TrCel7A, TrCel6A and TrCel7B have been deleted (U.S. Publication No. 2010-0221778). Strain BTR213 is a proprietary strain of Iogen Corporation derived from *T. reesei* strain RutC30 (ATCC® number 56765™). A uridine auxotroph of P297J, P297Jaux4, was obtained through selection of mutants spontaneously resistant to 0.15% w/v 5-fluoro-orotic-acid (FOA).

Figure 2:
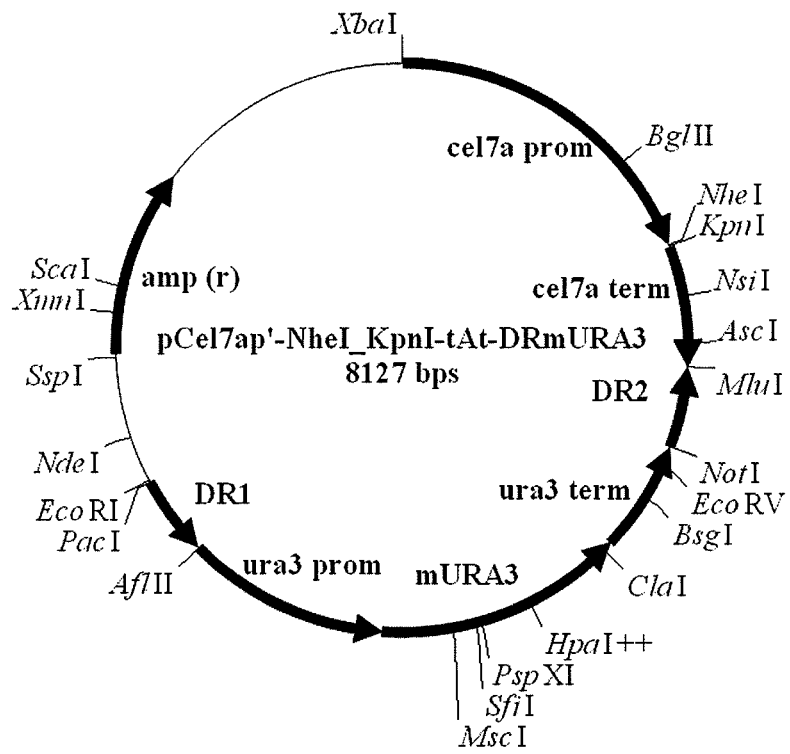
FIG. 2 shows a map of the plasmid vector pTr7Ap'-NheI-KpnI-7aT-DRmUra3 used to direct the expression and secretion of isolated cellobiohydrolases in *Trichoderma* host strains.

Plasmid pJET1.2 vector was obtained from Fermentas as a part of the CloneJET™ PCR Cloning Kit (cat. No. K1232). The *Trichoderma reesei* transformation vectors used to express TrCel7A, TrCel7A-R449E-R450E, and isolated TrCel7A cellobiohydrolases derived therefrom, were either pTr7Ap-NheI-KpnI-7aT-DRmUra3 or pTr7Ap'-NheI-KpnI-7aT-DRmUra3 (FIGS. 1 and 2, respectively). Both promote transcription of polynucleotides encoding isolated cellobiohydrolases using trcel7a promoter and terminator. Plasmid pTr7Ap-NheI-KpnI-7aT-DRmUra3 contains the wild-type trcel7a promoter; plasmid pTr7Ap'-NheI-KpnI-7aT-DRmUra3 contains four repeats of the last 18 base pairs of the promoter at the 3' end. These vectors also contains NheI and KpnI sites for cloning of polynucleotides encoding isolated cellobiohydrolases, direct repeats to promote integration targeted at the native trcel7a locus, and the *T. reesei* ura3 gene to allow growth of transformants on uracil-depleted media.

Example 2

Site-Saturation Mutagenesis (SSM) of TrCel7A a. SSM PCR

Site-saturation mutagenesis (SSM) libraries of TrCel7A were generated with primers containing a degenerate codon (NNS) targeting various amino acid positions. SSM was performed using a two-step PCR method involving Megaprimer synthesis followed by PCR-mediated overlap extension. PCR reactions were carried out using iProof™ High-Fidelity DNA Polymerase (Bio-Rad). A vector containing genomic DNA encoding TrCel7A with flanking sequences (SEQ ID NO: 384) was used as the template for the L375X library. A vector containing genomic DNA encoding TrCel7A-R449E-R450E with flanking sequences (SEQ ID NO: 385) served as the template for all other SSM libraries.

For each SSM library, MegaPrimer A was amplified using the external forward primer AC639 with an internal mutagenic reverse primer, while MegaPrimer B was derived by combining the external reverse primer AC640 with an internal mutagenic forward primer. The mutagenic primers contained a degenerate codon sequence to introduce random amino acid substitutions at the targeted sites. All primer sequences are listed in Table 5. The MegaPrimers A and B were subjected to agarose gel electrophoresis and purified from the gel using the Wizard SV® Gel and PCR Clean-Up system (Promega). In the second round of PCR, both MegaPrimers for a given SSM library were allowed to anneal and extend for 5 to 10 cycles to generate the final template. The external primers AC639 and AC640 were then added for another 25 cycles to amplify the final product. The final SSM PCR amplicons were subjected to agarose gel electrophoresis and the ~1.7 kb TrCel7A amplicons were purified from the gel using the Wizard SV® Gel and PCR Clean-Up system (Promega).

TABLE 5

List of primers used to generate the TrCel7A SSM libraries.

| Target Amino Acid | Orientation | Primer name | Sequence (5' to 3')[1] | SEQ ID NO: |
|---|---|---|---|---|
| N/A (external primers) | Forward | AC639 | GCGGACTGCGCATCGCTAGCATGTATCGGAAGTTGGCCGTC | 386 |
| | Reverse | AC640 | TTCGCCACGGAGCTGGTACCTTACAGGCACTGAGAGTAGTAAG | 387 |
| S46 | Reverse | NM201 | GTTCGTAGCGTGAGTCCAG | 388 |
| | Forward | NM202 | CTGGACTCACGCTACGAACNNSAGCACGAACTGCTACGATG | 389 |
| D52 | Reverse | NM203 | GTAGCAGTTCGTGCTGCTGTTCG | 390 |
| | Forward | NM204 | CGAACAGCAGCACGAACTGCTACNNSGGCAACACTTGGAGCTCGACCC | 391 |
| G53 | Reverse | NM205 | ATCGTAGCAGTTCGTGCTGCTGTTC | 392 |
| | Forward | NM206 | GAACAGCAGCACGAACTGCTACGATNNSAACACTTGGAGCTCGACC | 393 |
| F95 | Reverse | NM211 | GCCAATGGAGAGGCTG | 394 |
| | Forward | NM212 | CAGCCTCTCCATTGGCNNSGTCACCCAGTCTGCGCAGAAGAAC | 395 |
| A100 | Reverse | NM213 | AGACTGGGTGACAAAGCCAATG | 396 |
| | Forward | NM214 | CATTGGCTTTGTCACCCAGTCTNNSCAGAAGAACGTTGGCGCTC | 397 |
| K102 | Reverse | NM215 | CTGCGCAGACTGGGTGACAAAG | 398 |
| | Forward | NM216 | CTTTGTCACCCAGTCTGCGCAGNNSAACGTTGGCGCTCGCCTTTACC | 399 |

TABLE 5-continued

List of primers used to generate the TrCe17A SSM libraries.

| Target Amino Acid | Orientation | Primer name | Sequence (5' to 3')[1] | SEQ ID NO: |
|---|---|---|---|---|
| G139 | Reverse | NM219 | GCACCTTGAATTGGCCAG | 400 |
|  | Forward | NM220 | CTGGCCAATTCAAGGTGCNNSTTAACGGAGCTCTCTAC | 401 |
| A143 | Reverse | NM221 | TCCGTTCAAGCCGCACCTTG | 402 |
|  | Forward | NM222 | CAAGGTGCGGCTTGAACGGANNSCTCTACTTCGTGTCCATGGACGC | 403 |
| L144 | Reverse | NM223 | AGCTCCGTTCAAGCCGC | 404 |
|  | Forward | NM224 | GCGGCTTGAACGGAGCTNNSTACTTCGTGTCCATGGACGCGG | 405 |
| K181 | Reverse | NM229 | CAGATCGCGGGGACACTG | 406 |
|  | Forward | NM230 | CAGTGTCCCCGCGATCTGNNSTTCATCAATGGCCAGGCCAAC | 407 |
| N197 | Reverse | NM231 | GGATGACGGCTCCCAG | 408 |
|  | Forward | NM232 | CTGGGAGCCGTCATCCNNSAACGCGAACACGGGCATTG | 409 |
| N200 | Reverse | NM233 | CGCGTTGTTGGATGACG | 410 |
|  | Forward | NM234 | CGTCATCCAACAACGCGNNSACGGGCATTGGAGGACAC | 411 |
| N219 | Reverse | NM237 | GGCCTCCCAGATATCC | 412 |
|  | Forward | NM238 | GGATATCTGGGAGGCCNNSTCCATCTCCGAGGCTCTTAC | 413 |
| D241 | Reverse | NM239 | ACCCTCGCAGATCTCCTGG | 414 |
|  | Forward | NM240 | CCAGGAGATCTGCGAGGGTNNSGGGTGCGGCGGAACTTAC | 415 |
| D249 | Reverse | NM241 | GGAGTAAGTTCCGCCGCACCC | 416 |
|  | Forward | NM242 | GGGTGCGGCGGAACTTACTCCNNSAACAGATATGGCGGCACTTG | 417 |
| G253 | Reverse | NM243 | ATATCTGTTATCGGAGTAAGTTC | 418 |
|  | Forward | NM244 | GAACTTACTCCGATAACAGATATNNSGGCACTTGCGATCCCGATG | 419 |
| G260 | Reverse | NM277 | ATCGGGATCGCAAGTGCC | 420 |
|  | Forward | NM278 | GGCACTTGCGATCCCGATCCSTGCGACTGGAACCCATAC | 421 |
| N264 | Reverse | NM247 | CCAGTCGCAGCCATCG | 422 |
|  | Forward | NM248 | CGATGGCTGCGACTGGNNSCCATACCGCCTGGGCAACACCAG | 423 |
| N327 | Reverse | NM279 | GAGCTCGTTGCCAGAGTAAC | 424 |
|  | Forward | NM280 | GTTACTCTGGCAACGAGCTCNNSGATGATTACTGCACAGCTGAGG | 425 |
| F343 | Reverse | NM253 | AGAGGATCCGCCGAATTCTG | 426 |
|  | Forward | NM254 | CAGAATTCGGCGGATCCTCTNNSTCAGACAAGGGCGGCCTGAC | 427 |
| D368 | Reverse | NM257 | CCACAGACTCATGACCAG | 428 |
|  | Forward | NM258 | CTGGTCATGAGTCTGTGGNNSGATGTGAGTTTGATGGAC | 429 |
| M374 | Reverse | NM261 | GTTGGCGTAGTACTGTAAC | 430 |
|  | Forward | NM262 | GTTACAGTACTACGCCAACNNSCTGTGGCTGGACTCCACC | 431 |
| L375 | Reverse | KAP065 | CATGTTGGCGTAGTACTG | 432 |
|  | Forward | KAP064 | CAGTACTACGCCAACATGNNSTGGCTGGACTCCACCTAC | 433 |
| S379 | Reverse | NM265 | GTCCAGCCACAGCATGTTG | 434 |
|  | Forward | NM266 | CAACATGCTGTGGCTGGACNNSACCTACCCGACAAACGAG | 435 |
| P382 | Reverse | NM267 | GTAGGTGGAGTCCAGCCACAG | 436 |
|  | Forward | NM268 | CTGTGGCTGGACTCCACCTACNNSACAAACGAGACCTCCTCC | 437 |

TABLE 5-continued

List of primers used to generate the TrCel7A SSM libraries.

| Target Amino Acid | Orientation | Primer name | Sequence (5' to 3')[1] | SEQ ID NO: |
|---|---|---|---|---|
| E385 | Reverse | NM269 | GTTTGTCGGGTAGGTGGAG | 438 |
|  | Forward | NM270 | CTCCACCTACCCGACAAACNNSACCTCCTCCACACCC GGTGC | 439 |
| P390 | Reverse | NM271 | TGTGGAGGAGGTCTCGTTTG | 440 |
|  | Forward | NM272 | CAAACGAGACCTCCTCCACANNSGGTGCCGTGCGCG GAAG | 441 |

[1]In the degenerate codon, the N stands for A, T, C or G whereas S stands for C or G.

b. In Vitro Recombination and Amplification of the Libraries in *Escherichia coli*

The vector used for cloning of the L375X library was pTr7Ap'-NheI-KpnI-7aT-DRmUra3 (FIG. 2) whereas the vector used for all other SSM libraries was pTr7Ap-NheI-KpnI-7aT-DRmUra3 (FIG. 1). Both vectors were digested with NheI and KpnI and treated with Antarctic phosphatase (New England Biolabs). The digested vectors were subjected to agarose gel electrophoresis and the ~8.1 kb linearized vector fragment was purified from the gel using the Wizard SV® Gel and PCR Clean-Up system (Promega).

The DNA concentration of the linearized vectors and each SSM PCR amplicon were determined using the Quant-iT™ PicoGreen® dsDNA Reagent Kit (Invitrogen) following the manufacturer's protocol. The external primers (AC639 and AC640) contain sequences which are homologous to the free ends of the linearized receiving vector. This homology allows for cloning of the SSM PCR amplicons into the receiving vector by in vitro recombination. The linear vector fragment and each SSM PCR amplicon were cloned by in vitro recombination using In-Fusion™ recombinase (Clontech) following manufacturer's recommendations. The recombinase reactions were used to transform 100 µL of DH5α™ MAX® Efficiency competent cells (Invitrogen) following the manufacturer's recommendations. The cells from each library transformation were plated on two 15 cm selective agar media plates and allowed to grow overnight at 37° C.

The resulting colonies from each library were scraped from the transformation plates. The protocol for harvesting the cells was adapted from Current Protocols in Molecular Biology Unit 5.8A: Production of a complete cDNA library, pg. 5.8.4 (Klickstein, L. B., 2001). Specifically, Luria Bertani broth (5 mL) was added to each 15 cm agar plate and allowed to sit at room temperature for 5 minutes. The colonies were gently scraped from the surface of the agar using a sterile plastic cell scraper (Costar). The cells from both plates of the library were pooled together. Glycerol stocks (15% final concentration) of the cell suspension were made for future amplification of the library if needed. The plasmid DNA was extracted from the remaining cell suspension using the Wizard® Plus SV Minipreps DNA Purification System (Promega) and used for subsequent transformation of *T. reesei* host strain P297Jaux (Example 4).

Example 3

Random Mutagenesis of TrCel7A a. Error-Prone PCR

Random mutagenesis libraries were generated by error-prone PCR using Mutazyme® II DNA polymerase (Agilent). Two error-prone PCR were performed. One reaction used 20 fmol of a vector containing a polynucleotide encoding TrCel7A-R449E-R450E and flanking sequences (SEQ ID NO: 442). Another error-prone PCR was performed using 100 fmol of a vector containing a polynucleotide encoding TrCel7A and flanking sequences (SEQ ID NO: 443). Both reactions contained the Mutazyme® II DNA polymerase with primers AC639 and AC640. The annealing temperature was set to 60° C. and the amplification was done for 20 cycles. The error-prone PCR amplicons were subjected to agarose gel electrophoresis and the ~1.6 kb amplicons were purified from the gel using the Wizard SV® Gel and PCR Clean-Up system (Promega). Primer sequences are shown below:

AC639:
(SEQ ID NO: 386)
5' GCGGACTGCGCATCGCTAGCATGTATCGGAAGTTGGCCGTC

AC640:
(SEQ ID NO: 387)
5' TTCGCCACGGAGCTGGTACCTTACAGGCACTGAGAGTAGTAAG b. In Vitro Recombination and Amplification of the Libraries in *Escherichia coli*

The pTrCel7Ap-NheI KpnI-DRmUra3 (FIG. 2) vector was digested with NheI and KpnI and treated with Antarctic Phosphatase (New England Biolabs). The digested vector was subjected to agarose gel electrophoresis and the ~8.1 kb linearized vector fragment was purified from the gel using the Wizard SV® Gel and PCR Clean-Up system (Promega). The DNA concentration of the linearized vector and the error-prone PCR amplicon was determined using the Quant-iT™ PicoGreen® dsDNA Reagent Kit (Invitrogen) following the manufacturer's protocol. The external primers (AC639 and AC640) contain sequence which is homologous to the free ends of the linearized receiving vector. This homology allows for cloning of the error-prone PCR amplicons into the receiving vector by in vitro recombination. The linear vector fragment and the library of error-prone PCR amplicons were cloned by in vitro recombination using In-Fusion™ recombinase (Clontech) following manufacturer's recommendations.

The recombinase reactions were used to transform 500 µL of DH5α™ MAX® Efficiency competent cells (Invitrogen) following the manufacturer's recommendations. The cells from the library transformation were plated on ten 15 cm selective agar media plates and allowed to grow overnight at 37° C.

The resulting colonies from the library were scraped from the transformation plates. The protocol for harvesting the cells was adapted from Current Protocols in Molecular Biology Unit 5.8A (Ausubel, et al., Eds., John Wiley & Sons, p.

5.8.4). Specifically, Luria Bertani broth (5 mL) was added to each 15 cm agar plate and allowed to sit at room temperature for 5 minutes. The colonies were gently scraped from the surface of the agar using a sterile plastic cell scraper (Costar). The cells from all ten plates of the library were pooled together. Glycerol stocks (15% final concentration) of the cell suspension were made for future amplification of the library if needed. The plasmid DNA was extracted from the remaining cell suspension using the Wizard® Plus SV Midipreps DNA Purification System (Promega) and used for subsequent transformation of *T. reesei* host strain P297Jaux (Example 4).

Example 4

Expression of Isolated Cellobiohydrolases in *T. reesei* Host Strain a. Biolistic Transformation The transformations of strain P297Jaux with TrCel7A library expression vectors prepared as in Examples 2 and 3 were performed by biolistic gold particle bombardment using PDS-1000/He system with Hepta adapter (BioRad; E.I. DuPont de Nemours and Company). Gold particles (median diameter of 0.6 um, BioRad Cat. No. 1652262) were used as microcarriers. Prior to transformation, *T. reesei* strain P297Jaux was grown on potato dextrose agar (PDA) (Difco) plates for 4-5 days at 30° C. until sporulated. Spores were collected and suspended in sterile water. Approximately 3.5× $10^8$ spores were plated on 100 mm diameter plates containing minimal media (MM). The following parameters were used for the transformation: a rupture pressure of 1350 psi, a helium pressure of 28 mm Hg, target distance 3 cm. After particle delivery, spores from each transformation plate were washed with 2.5 mL of sterile 0.9% NaCl, spread on 3-4 150 mm plates containing MM and incubated at 30° C. for 5-10 days. All transformants were transferred to PDA media and incubated at 30° C. until sporulation and further screen-out on ASC plates.

Minimal Medium (MM) Agar:

| Component | Amount for 1 L of medium |
| --- | --- |
| $KH_2PO_4$ | 10 g |
| $(NH_4)_2SO_4$ | 6 g |
| $Na_3Citrate-2H_2O$ | 3 g |
| $FeSO_4—7H_2O$ | 5 mg |
| $MnSO_4—H_2O$ | 1.6 mg |
| $ZnSO_4—7H_2O$ | 1.4 mg |
| $CaCl_2—2H_2O$ | 2 mg |
| Agar | 20 g |
| 20% Glucose f.s.[1] | 50 mL |
| 1M $MgSO4—7H_2O$ f.s.[1] | 4 mL |
| | pH to 5.5 |

[1] f.s.—filter sterilized b. Screen-Out of Transformants Expressing Inactive Cellobiohydrolases Phosphoric acid swollen cellulose (ASC) was prepared as follows: 400 g of SIGMACel T50 was wetted with 600 mL of acetone and mixed thoroughly with a paddle mixer in a 20 L bucket. The bucket content was then cooled in an ice water bath. A total of 4 L of commercial grade phosphoric acid (85%) was slowly added to the wetted cellulose and constantly stirred. Precooled deionized water was added to the acid/cellulose gelatinous mixture resulting in precipitation of a white clumpy material. A solution of 5-7% bicarbonate was added to begin neutralizing the slurry. The solution was slowly added to the slurry with constant mixing. Once the slurry pH was 5-7, it was filtered through GF/A filter paper by vacuum filtration. The moist white cellulose preparation was washed with greater than 4L of deionized water to ensure salts, and soluble sugars were removed from the resulting amorphous cellulose. Typical solids content of the cellulose after acid treatment was 7-9%.

For screen-out of transformants expressing inactive TrCel7A cellobiohydrolases, the ASC was treated with an endoglucanase enriched enzyme as follows. 64.7 g of ASC was combined with 25 mL of 250 mM citrate buffer pH 5.0. Water was added to make up the slurry to 120 mL. The slurry was contained in a 250 mL screw-capped Erlenmeyer flask. About 170-180 mg of total protein comprising a cellulase preparation from *Trichoderma reesei* strain deficient in TrCel7A and TrCel6A cellulase components was added to the slurry in a volume no greater than 10 mL. The dose of endoglucanase enriched enzyme was 40 mg of protein/g of cellulose (dry wt). Flasks were incubated overnight at 50° C. for 16 h with shaking at 200 rpm followed by homogenization using the Powergen 1000 homogenizer from Fisher Scientific. Enzyme-treated ASC was then diluted with an equal volume of water and pH adjusted to 4.5-4.6 before blending for 1 minute in a standard kitchen blender followed by sterilizing in an autoclave at standard temperatures and pressures. At this point the concentration of ASC is 25 g/L.

Assessment of TrCel7A activity in *Trichoderma* transformants expressing isolated TrCel7A cellobiohydrolases was performed by germinating spores of transformants on ASC Screen-Out Medium (Table 6). Sterilized media (200 mL) was poured into a 245 mm×245 mm×1.5 mm square plastic bioassay plate. Transformants expressing isolated TrCel7A cellobiohydrolase, wild-type TrCel7A or TrCel7A-R449E-R450E were spotted on the medium and plates were incubated at 30° C. for 6 days, followed by 1 day incubation at 50° C. TrCel7A activity was assessed by formation of clearing zone around transformant colonies.

TABLE 6

Composition of ASC Screen Out Medium

| Component | Amount per liter of medium |
| --- | --- |
| 5X Minimal Media Salts* | 40 mL |
| Proteose Peptone#3 (Difco) | 0.2 g |
| Bovine Oxgall (Difco) | 1.8 g |
| Agar | 4 g |
| Deionized water | 80 mL |
| Phosphoric Acid Swollen Cellulose (25 g/L) | 80 mL |
| 1M $MgSO_4—7H_2O$ | 4 mL |

*5X Minimal Media Salts Composition (per L of medium): 50 g $KH_2PO_4$, 30 g $NH_4(SO_4)$, 15 g $Na_3$-Citrate-$2H_2O$, 25 mg $FeSO_4—7H_2O$, 8 mg $MnSO_4—H_2O$, 7 mg $ZnSO_4—7H_2O$, 10 mg $CaCl_2—2H_2O$ Example 5

Production of Isolated TrCel7A Cellobiohydrolases in Microcultures

*T. reesei* strains were grown on Potato Dextrose Agar at 28-30° C. until a confluent lawn of spores was obtained. Spores were collected and used to inoculate 0.7 mL of expression medium having the following initial composition: 100 mM DL-malic acid pH 3.5, 12.7 g/L $(NH_4)_2SO_4$, 8.0 g/L $KH_2PO_4$, 4.0 g/L $MgSO_4*7H_2O$, 1.02 g/L $CaCl_2$, 5.0 g/L dry corn steep, 10 mg/L $FeSO_4*7H_2O$, 3.2 mg/L $MnSO_4*H_2O$, 2.8 g/L ZnSO$_4$*7H$_2$O. The cultures were grown at 28-30° C. using an inducing carbohydrate source in 96-well deep plates agitated at 45-60 rpm on a RolloDrum (New Brunswick Scientific, Edison, N.J.) tilted at a 60-80° angle. After 5-6 days, the culture was centrifuged and the supernatant used for analyses.

For larger-scale analyses, spores of each variant were collected and used to inoculate 12 wells of a 24-well deep plate, each well containing 4 mL of expression medium described above. The culture were grown at 28-30° C. using an inducing carbohydrate source and agitated on a one inch orbit shaker at 225-275 rpm. After 5-6 days, the culture was centrifuged and the supernatant from each of the 12 wells was pooled and analyzed.

The concentration of TrCel7A in the microculture filtrates was determined by ELISA. Culture supernatants and purified component standards were diluted to 0.01-10 µg/mL in phosphate-buffered saline (PBS; pH 7.2) and incubated overnight at 4° C. in microtitre plates (Costar EIA #9018). These plates were washed with PBS containing 0.1% Tween-20 (PBS/Tween) and then incubated in PBS containing 1% bovine serum albumin (PBS/BSA) for 1 h at room temperature. Blocked microtitre wells were washed with PBS/Tween. Rabbit polyclonal antisera specific for TrCel7A was diluted in PBS/BSA, added to separate microtitre plates and incubated for 2 h at room temperature. Plates were washed and incubated with a goat anti-rabbit antibody coupled to horseradish peroxidase (Sigma Cat. No. A6154), diluted 1:2000 in PBS/BSA, for 1 h at room temperature. After washing, tetramethylbenzidine (Sigma Cat. No. T0440) was added to each plate and incubated for 30 min at room temperature. The absorbance at 660 nm was measured in each well and converted into protein concentration using a TrCel7A standard curve.

Example 6

Sequencing *Trichoderma reesei* Library Clones

To isolate *T. reesei* genomic DNA, 1 mL of Potato Dextrose Broth (Difco) was inoculated with *T. reesei* spores collected from a Potato Dextrose Agar plate (or from a glycerol stock) with a sterile pipette tip. The cultures were grown for 20 to 24 h at 30° C. The mycelia were pelleted by centrifugation at 20,000×g for 5 minutes.

The genomic DNA was extracted using the Wizard Genomic DNA Extraction Kit (Promega) following a modified protocol. Nuclei Lysis Solution (included in the kit) and 400-650 µm glass beads were added to the pelleted mycelia. The mycelia were then physically lysed using a vortex or the FastPrep® homogenizer at max speed (6.5 meters per sec) for 1 min. The genomic DNA was then purified following the manufacturer's protocol 3.E: Isolating gDNA from plant tissue. The concentration of DNA was determined by measuring the absorbance of the solution at 260 nm (Sambrook et al., 1989, Molecular Cloning: A Laboratory Manual, Second Edition", Cold Spring Harbor Press, p. C1).

The extracted genomic DNA was used as a template for PCR amplification of TrCel7A from the *T. reesei* genome. The reverse primer KAP070 was designed to be specific to the vector backbone of the library, to be sure that the amplified TrCel7A gene was in fact the inserted copy from the library and not the endogenous genetic material from the *T. reesei* genome. The primers KAP070 and KAP072 were used along with iProof™ High-Fidelity DNA Polymerase (Bio-Rad) in the PCR mixture. Primer sequences are shown below:

KAP070:
(SEQ ID NO: 444)
5' AAGCCGATGTCACACGCG

KAP072:
(SEQ ID NO: 445)
5' CAGATCCTCCAGGAGACTTG

The amplicons (~2.2 kb for TrCel7A cDNA or ~2.3 kb for TrCel7A with both introns) were subjected to agarose gel electrophoresis and were purified from the gel using the Wizard SV® Gel and PCR Clean-Up system (Promega). The concentration of DNA was determined by measuring the absorbance of the solution at 260 nm (p. C1 in Sambrook et al., 1989, which is incorporated herein by reference).

The purified amplicons were either sent directly for sequencing, or blunt-end cloned into the pJET1.2 vector using the CloneJET™ kit (Fermentas) following manufacturer's recommendations, or subjected to a second round of amplification prior to be sent for sequencing. The pJET1.2-TrCel7A constructs were transformed into Subcloning Efficiency™ DH5α™ competent cells (Invitrogen) following the manufacturer's recommendations. The plasmid DNA was mini prepped from either a single transformant or a mixture of transformants, and this plasmid DNA was sent for sequence analysis by an outside sequencing facility (Genome Quebec).

Example 7

Screening for Isolated Cellobiohydrolases with Improved Specific Activity on Cellulose Isolated TrCel7A cellobiohydrolases from *T. reesei* microcultures (Example 5) were tested in a 0.20 mL citrate buffered (pH 5) cellulose hydrolysis assay using a 96-well microplate format. An aliquot of supernatant from each microculture was added to each well containing 0.15% w/v cellulose and incubated for 20 h at 50° C. *T. reesei* supernatants were complemented with *Trichoderma reesei* TrCel7B and TrCel5A endoglucanases (40 mg protein/g cellulose each) and 125 IU/g cellulose *A. niger* beta-glucosidase. Contained in each 96-well microplate were 6 corresponding parent controls for comparison. Cellulase activity was measured by a decrease in turbidity (OD 600). Specific activity was determined by dividing the cellulase activity by the concentration of TrCel7A (as determined by ELISA; Example 5). The specific activity for each isolated TrCel7A cellobiohydrolase was compared to the average of the 6 corresponding parent controls of a particular microplate. A standard deviation was determined for the 6 parent controls and isolated TrCel7A cellobiohydrolases exhibiting a specific activity of at least 2.5 standard deviations from the control were selected as positive. All positives were produced again in microculture, re-screened and polynucleotides encoding isolated cellobiohydrolases exhibiting improved specific activity on cellulose were sequenced as in Example 6.

TABLE 7

Isolated Cellobiohydrolases with Improved Specific Activity on Cellulose

| Parent | Amino Acid Substitution(s) | Improvement |
| --- | --- | --- |
| SEQ ID NO: 1 | P137S; K353M | +++ |
| SEQ ID NO: 1 | T5I; T26A; E325K; T356I | +++ |
| SEQ ID NO: 446 | P390A | ++ |
| SEQ ID NO: 446 | N200F | ++ |
| SEQ ID NO: 446 | P390W | ++ |
| SEQ ID NO: 446 | G358S; P390C | + |

TABLE 7-continued

Isolated Cellobiohydrolases with Improved Specific Activity on Cellulose

| Parent | Amino Acid Substitution(s) | Improvement |
|---|---|---|
| SEQ ID NO: 446 | P390K | + |
| SEQ ID NO: 446 | D241L | + |
| SEQ ID NO: 446 | P390G | + |
| SEQ ID NO: 446 | P382L | + |
| SEQ ID NO: 446 | F95L | + |
| SEQ ID NO: 446 | N219S | + |
| SEQ ID NO: 446 | E385G | + |
| SEQ ID NO: 446 | G253D | + |
| SEQ ID NO: 446 | E385I | + |
| SEQ ID NO: 1 | T332I; M364V | + |

Improvement: +++ >10 sd from parental average; ++ >4 sd from parental average; and + >2 sd from parental average (sd, standard deviation)

Example 8

Screening for Isolated Cellobiohydrolases with Improved Specific Activity on Lignocellulose Wheat straw was pretreated using the methods described in U.S. Pat. No. 4,461,648. Following pretreatment, sodium benzoate was added at a concentration of 0.5% as a preservative. Prior to use, the pretreated material was then washed with six volumes of lukewarm (~35° C.) tap water using a Buchner funnel and filter paper.

Isolated TrCel7A cellobiohydrolases from *T. reesei* microcultures (Example 5) were tested in a 0.21 mL citrate buffered (pH 5) wheat straw hydrolysis assay using a 96-well microplate format. An aliquot of supernatant from each microculture was added to a well containing wheat straw (0.9% w/v cellulose) and incubated for 18 h at 50° C. *T. reesei* supernatants were complemented with *Trichoderma reesei* TrCel7B and TrCel5A endoglucanases (40 mg protein/g cellulose each) and 125 IU/g cellulose *A. niger* beta-glucosidase. Contained in each 96-well microplate were 6 corresponding parent controls for comparison. Microplates were centrifuged for 3 min at 2800×g and an aliquot of supernatant was sampled for glucose content. Enzyme activity was measured via the detection of glucose using a standard glucose oxidase/peroxidase coupled reaction assay (Trinder, P. (1969) Annals of Clinical Biochemistry, 6:24-27). Specific activity was determined by dividing the enzyme activity by the concentration of TrCel7A (as determined by ELISA; Example 5). The specific activity for each isolated TrCel7A cellobiohydrolase was compared to the average of the 6 corresponding parent controls on a particular microplate. A standard deviation was determined for the 6 corresponding parent controls and isolated TrCel7A cellobiohydrolases exhibiting a specific activity of at least 2.5 standard deviations from the control were selected as positive. All positives were produced again in microculture, re-screened and polynucleotides encoding isolated cellobiohydrolases exhibiting improved specific activity on lignocellulose were sequenced as in Example 6.

TABLE 8

Isolated Cellobiohydrolases with Improved Specific Activity on Lignocellulose

| Parent | Amino Acid Substitution(s) | Improvement* |
|---|---|---|
| SEQ ID NO: 446 | N45D; D52R | +++ |
| SEQ ID NO: 446 | S46T | +++ |
| SEQ ID NO: 446 | S46G | +++ |
| SEQ ID NO: 446 | P390G | +++ |
| SEQ ID NO: 446 | Q27L | ++ |
| SEQ ID NO: 446 | D241L | ++ |
| SEQ ID NO: 446 | P390L | ++ |
| SEQ ID NO: 446 | G53A | ++ |
| SEQ ID NO: 446 | D241R | ++ |
| SEQ ID NO: 446 | S46L | ++ |
| SEQ ID NO: 446 | N197L | ++ |
| SEQ ID NO: 446 | D368A | + |
| SEQ ID NO: 446 | E385L | + |
| SEQ ID NO: 446 | N200F | + |
| WT TrCel7A | Q186K; Q351R | + |
| SEQ ID NO: 1 | A372T; V393A | + |

*Improvement: +++ >10 sd from parental average; ++ >5 sd from parental average; and + >2 sd from parental average (sd, standard deviation)

Example 9

Screening Isolated Cellobiohydrolases with Reduced Inhibition by Glucose

Isolated TrCel7A cellobiohydrolases from *T. reesei* microcultures (Example 5) were tested in a 0.20 mL citrate buffered (pH 5) cellulose hydrolysis assay using a 96-well microplate format. An aliquot of supernatant from each microculture was added to a well containing 60 g/L glucose and to a well containing no glucose, and incubated with 0.15% w/v cellulose for 20 h at 50° C. *T. reesei* supernatants were complemented with *Trichoderma reesei* TrCel7B and TrCel5A endoglucanases (40 mg protein/g cellulose each) and 125 IU/g cellulose *A. niger* beta-glucosidase. Contained in each 96-well microplate were 6 corresponding parent controls for comparison. Cellulase activity was measured by a decrease in turbidity (OD 600). A ±glucose activity ratio was calculated for all isolated TrCel7A cellobiohydrolases and the 6 corresponding parent controls by dividing the cellulase activity in the presence of glucose by the cellulase activity in the absence of glucose. The ±glucose activity ratio for each isolated TrCel7A cellobiohydrolase was compared to the average of the 6 corresponding parent controls on a particular microplate. A standard deviation was determined for the 6 corresponding parent controls and isolated TrCel7A cellobiohydrolases exhibiting a ±glucose activity ratio at least 2 standard deviations above that of the control were selected as positive. All positives were produced again in microculture, re-screened and polynucleotides encoding isolated cellobiohydrolases exhibiting reduced inhibition by glucose were sequenced as in Example 6.

TABLE 9

Isolated TrCel7A cellobiohydrolases with Reduced Inhibition by Glucose

| Parent | Amino Acid Substitution(s) | Improvement* |
|---|---|---|
| SEQ ID NO: 446 | G53A | +++ |
| SEQ ID NO: 446 | D52T | +++ |
| SEQ ID NO: 446 | D52W | +++ |
| SEQ ID NO: 446 | D241R | +++ |
| SEQ ID NO: 446 | G139Q | +++ |
| SEQ ID NO: 446 | G53R | ++ |
| SEQ ID NO: 446 | D241V | ++ |
| SEQ ID NO: 446 | L144V | ++ |
| SEQ ID NO: 446 | A143L | ++ |
| SEQ ID NO: 446 | S379C | ++ |
| SEQ ID NO: 1 | S46I; E193G; F311L; T383S | ++ |

TABLE 9-continued

Isolated TrCel7A cellobiohydrolases with Reduced Inhibition by Glucose

| Parent | Amino Acid Substitution(s) | Improvement* |
|---|---|---|
| SEQ ID NO: 1 | T356A | ++ |
| SEQ ID NO: 1 | R39L; N54S; G88V; F129S; T246S; T271I; N324D; S298P | ++ |
| SEQ ID NO: 1 | P13T; N184S | ++ |
| SEQ ID NO: 1 | T26S; I237T | ++ |
| SEQ ID NO: 1 | P13H; G358S; M364V | ++ |
| SEQ ID NO: 446 | K286E; S379E | + |
| SEQ ID NO: 446 | S46T | + |
| SEQ ID NO: 446 | D52R | + |
| SEQ ID NO: 446 | G139M | + |
| SEQ ID NO: 446 | A100W | + |
| SEQ ID NO: 446 | G53M | + |
| SEQ ID NO: 446 | A100V | + |
| SEQ ID NO: 446 | N264Y | + |
| SEQ ID NO: 446 | G139S | + |
| SEQ ID NO: 446 | G139E | + |
| SEQ ID NO: 1 | L375A | + |
| SEQ ID NO: 1 | T26A; P265T | + |
| SEQ ID NO: 446 | L144A | + |
| SEQ ID NO: 1 | G22D | + |
| SEQ ID NO: 446 | A100T | + |
| SEQ ID NO: 1 | S419F | + |
| SEQ ID NO: 446 | N264C | + |
| SEQ ID NO: 446 | G53W | + |
| SEQ ID NO: 446 | P390L | + |
| SEQ ID NO: 446 | D249C | + |
| SEQ ID NO: 1 | P314A | + |
| SEQ ID NO: 446 | Q27L | + |
| SEQ ID NO: 1 | S87T | + |
| SEQ ID NO: 1 | G430D | + |
| SEQ ID NO: 446 | P382Q | + |
| SEQ ID NO: 1 | T281A; T454I | + |
| SEQ ID NO: 446 | P382L | + |
| SEQ ID NO: 1 | M213I; Q406P; F423Y; T446A | + |
| SEQ ID NO: 1 | L326F | + |
| SEQ ID NO: 446 | P390G | + |
| SEQ ID NO: 1 | N45D; G339D | + |
| SEQ ID NO: 1 | I183N; T447S | + |
| SEQ ID NO: 446 | S431R | + |
| SEQ ID NO: 446 | F343L | + |
| SEQ ID NO: 1 | S475N | + |

*Improvement: +++ >4 sd from parental average; ++ >3 sd from parental average; and + >2 sd from parental average (sd, standard deviation)

Example 10

Screening for Isolated Cellobiohydrolases with Increased Activity in the Presence of Lignocellulose Hydrolysate Unwashed pretreated wheat straw (prepared as in U.S. Publication No. 2010-0056774) was treated with a high dose of cellulase (75 mg/g) and incubated for 96 h at the optimal temperature for cellulase activity. The reaction was then boiled to inactivate enzyme and passed through a glass fiber filter to remove residual solids. The remaining filtrate is referred to herein as hydrolysate.

Isolated TrCel7A cellobiohydrolases from *T. reesei* microcultures (Example 5) were tested in a 0.25 mL citrate buffered (pH 5) cellulose hydrolysis assay using a 96-well microplate format. An aliquot of supernatant from each microculture was added to a well containing 100 µL hydrolysate (+hydrolysate) or 100 µL water (-hydrolysate), and incubated with 0.15% w/v cellulose for 20 h at 50° C. *T. reesei* supernatants were complemented with *Trichoderma reesei* TrCel7B and TrCel5A endoglucanases (40 mg protein/g cellulose each) and 125 IU/g cellulose *A. niger* beta-glucosidase. Contained in each 96-well microplate were 6 corresponding parent controls for comparison. Cellulase activity was measured by a decrease in turbidity (OD 600). A ±hydrolysate activity ratio was calculated for all isolated TrCel7A cellobiohydrolases and the 6 corresponding parent controls by dividing the cellulase activity in the presence of hydrolysate by the cellulase activity in the absence of hydrolysate. The ±hydrolysate activity ratio for each isolated TrCel7A cellobiohydrolase was compared to the average of the 6 corresponding parent controls on a particular microplate. A standard deviation was determined for the 6 corresponding parent controls and isolated cellobiohydrolases exhibiting a ±hydrolysate activity ratio at least 2 standard deviations above that of the control were selected as positive. All positives were produced again in microculture, re-screened and polynucleotides encoding isolated cellobiohydrolases exhibiting increased activity in the presence of lignocellulose hydrolysate were sequenced as in Example 6.

TABLE 10

Isolated Cellobiohydrolases with Increased Activity in the Presence of Lignocellulose Hydrolysate

| Parent | Amino Acid Substitution(s) | Improvement* |
|---|---|---|
| SEQ ID NO: 1 | D114E; D150N; T453S | ++ |
| SEQ ID NO: 1 | M111T; G435S | + |
| SEQ ID NO: 1 | I93V; V131A | + |
| SEQ ID NO: 1 | C209S; P265T; D378E; T445I | + |

*Improvement*: = ++ >3 sd from average parent; and + >2 sd from average parent (sd, standard deviation).

Example 11

Screening for Isolated Cellobiohydrolases with Reduced Inactivation by Lignin a. Preparation of Lignin Wheat straw was pretreated using the methods described in U.S. Pat. No. 4,461,648. Following pretreatment, sodium benzoate was added at a concentration of 0.5% as a preservative. Prior to lignin extraction, the pretreated material was then washed with six volumes of lukewarm (~35° C.) tap water using a Buchner funnel and filter paper.

Lignin was acid extracted from pretreated wheat straw (333 g wet; ~30% solids; ~60% cellulose) by stirring in 625 mL of 82% $H_2SO_4$ for 4 h. The remaining solids were filtered to dampness using a Buchner funnel and a glass fibre filter, resuspended in 2 L of water, and pH adjusted to 4.5 with NaOH. The solids were filtered and washed with 8 L water. The solids are referred to herein as "lignin".

Bovine serum albumin (BSA) treatment of lignin was performed by incubating equal amounts (w/w) of lignin and BSA (30 g/L, 50 mM citrate buffer, pH 5, 0.1% sodium benzoate) for 5 days at 50° C. with shaking.

b. High-Throughput Screening of Isolated Cellobiohydrolases

*T. reesei* microculture filtrates (Example 5) were diluted 5-fold in water and distributed as 0.15 mL aliquots for pre-incubation in a 0.25 mL citrate-buffered (50 mM; pH 5) reaction containing lignin (0.4% w/v) or BSA-treated lignin (0.4% w/v). Pre-incubations were performed for 2 h at 50° C. with orbital shaking (NB Innova 44) in a 96-well microplate containing 1 glass bead. Each 96-well microplate contained six corresponding parent cellobiohydrolase controls for comparison. Following pre-incubation, microplates were centrifuged for 5 min at 2800×g and the supernatant was aspirated for residual activity assays. Supernatant was diluted 10-fold in water prior to performing activity measurements.

Diluted supernatant (0.05 mL) was incubated with 0.25 mM 4-methylumbelliferyl-beta-D-lactoside (MUL) in a 100 µL citrate buffered (50 mM; pH 5) reaction for 15 minutes at 50° C. in a black Costar 3915 microplate. A 4-methylumbelliferone (4-MU) standard curve was prepared in the first column ranging from 5 to 0.08 µM. Reactions were stopped by adding 100 µL of 0.2 M glycine (pH 10) to all the wells. Fluorescence emission was measured at 445 nm following excitation at 370 nm. Residual enzyme activity was determined by converting the fluorescence units to the amount of 4-MU released. Activity ratios were calculated by dividing the residual enzyme activity in the presence of untreated lignin by the residual enzyme activity in the presence of BSA-treated lignin. The activity ratio for each isolated cellobiohydrolase was compared to the average of that of the six corresponding parent controls on a particular microplate. Positives (those having increased ratios) were selected at the 95% confidence level using a t-test. All positives were produced again in microculture, re-screened and polynucleotides encoding isolated cellobiohydrolases exhibiting reduced inactivation by lignin were sequenced as in Example 6.

TABLE 11

Isolated Cellobiohydrolases with Reduced Inactivation by Lignin

| Parent | Amino Acid Substitution(s)* | Normalized ratio |
|---|---|---|
| SEQ ID NO: 1 | T59A; S156G; C486stop | 2.18 |
| SEQ ID NO: 1 | T281I; T455A; Q463K | 2.05 |
| SEQ ID NO: 1 | Y466S | 1.97 |
| SEQ ID NO: 1 | G75S; S400G; C486stop | 1.96 |
| SEQ ID NO: 1 | G483V; S498stop | 1.93 |
| SEQ ID NO: 1 | D249N; Q487frame | 1.89 |
| SEQ ID NO: 1 | N54I; G471S | 1.88 |
| SEQ ID NO: 1 | N420D; G444D; L489P | 1.82 |
| SEQ ID NO: 446 | A100G | 1.70 |
| SEQ ID NO: 446 | N197A; Q468stop | 1.66 |
| SEQ ID NO: 1 | C138S | 1.65 |
| SEQ ID NO: 1 | G476D | 1.65 |
| SEQ ID NO: 1 | P194Q; T478ins | 1.65 |
| SEQ ID NO: 1 | V155M; C486R | 1.60 |
| SEQ ID NO: 1 | A316V; T383A; P437T; G467D | 1.60 |
| SEQ ID NO: 446 | P390V | 1.55 |
| SEQ ID NO: 446 | K102R; D130N | 1.53 |
| SEQ ID NO: 446 | P382I | 1.52 |
| SEQ ID NO: 446 | N200C | 1.50 |
| SEQ ID NO: 1 | N441D; T453I; G483S; L489Q | 1.50 |
| SEQ ID NO: 1 | L108I; N436D | 1.47 |
| SEQ ID NO: 1 | S211T; Q463L; V488D | 1.47 |
| SEQ ID NO: 1 | R450S; S482N | 1.37 |
| SEQ ID NO: 446 | K102S | 1.34 |
| SEQ ID NO: 446 | N200F | 1.34 |

TABLE 11-continued

Isolated Cellobiohydrolases with Reduced Inactivation by Lignin

| Parent | Amino Acid Substitution(s)* | Normalized ratio |
|---|---|---|
| SEQ ID NO: 446 | G253RQ463S | 1.33 |
| SEQ ID NO: 446 | K181L | 1.28 |

*"frame" indicates introduction of a frameshift starting at the indicated amino acid position; "stop" indicates introduction of a stop codon at the indicated amino acid position Example 12

Screening for Isolated Cellobiohydrolases with Increased Activity in the Presence of Lignin The ratio of specific activity on pretreated wheat straw ("WS activity" as described in Example 8) to the specific activity on cellulose ("cellulose activity" as described in Example 7) was calculated for each isolated cellobiohydrolase and the corresponding parent cellobiohydrolase controls. The WS activity:cellulose activity ratio for isolated cellobiohydrolase and was compared to the average WS activity:cellulose activity ratio of its 6 corresponding parent cellobiohydrolase controls on a particular microplate. A standard deviation was determined for the 6 corresponding parent cellobiohydrolase controls and isolated cellobiohydrolases exhibiting a WS activity:cellulose activity ratio of at least 2.5 standard deviations above that of the 6 corresponding parent cellobiohydrolase controls were selected as positive. All positives were produced again in microculture, re-screened and polynucleotides encoding isolated cellobiohydrolases exhibiting increased activity in the presence of lignin were sequenced as in Example 6.

TABLE 12

Isolated Cellobiohydrolases with Increased Activity in the Presence of Lignin

| Parent | Amino Acid Substitution(s) | Improvement |
|---|---|---|
| SEQ ID NO: 446 | A143G | +++ |
| SEQ ID NO: 446 | A197Q | +++ |
| SEQ ID NO: 1 | A372T; V393A | +++ |
| SEQ ID NO: 446 | A197W | +++ |
| SEQ ID NO: 1 | Y370H | ++ |
| SEQ ID NO: 446 | D368G | ++ |
| SEQ ID NO: 446 | F95Y | + |
| SEQ ID NO: 446 | D368A | + |
| SEQ ID NO: 1 | A299T | + |
| SEQ ID NO: 446 | M374V | + |

*Improvement: +++ >4 sd from average parent; ++ >3 sd from average parent; and + >2 sd from average parent (sd, standard deviation).

SEQUENCE LISTING (509 sequences)

SEQ ID NO: 1 - protein, 497 aa, Trichoderma reesei [sequence omitted]

SEQ ID NO: 2 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 3 - protein, 497 aa, Trichoderma reesei
QSACTLQSETHPHLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 4 - protein, 497 aa, Trichoderma reesei
QSACTLQSETHPTLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 5 - protein, 497 aa, Trichoderma reesei
QSACTLQSETHPPLTWQKCSSDGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 6 - protein, 497 aa, Trichoderma reesei
QSACTLQSETHPPLTWQKCSSGGTCAQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 7 - protein, 497 aa, Trichoderma reesei
QSACTLQSETHPPLTWQKCSSGGTCSQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 8 - protein, 497 aa, Trichoderma reesei
QSACTLQSETHPPLTWQKCSSGGTCTLQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 9 - protein, 497 aa, Trichoderma reesei
QSACTLQSETHPPLTWQKCSSGGTCTQQTGSVVIDANWLWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 10 - protein, 497 aa, Trichoderma reesei
QSACTLQSETHPPLTWQKCSSGGTCTQQTGSVVIDANWRWTHATDSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 11 - protein, 497 aa, Trichoderma reesei
QSACTLQSETHPPLTWQKCSSGGTCTQQTGSVVIDANWRWTHATNASTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 12 - protein, 497 aa, Trichoderma reesei
QSACTLQSETHPPLTWQKCSSGGTCTQQTGSVVIDANWRWTHATNGSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 13 - protein, 497 aa, Trichoderma reesei
QSACTLQSETHPPLTWQKCSSGGTCTQQTGSVVIDANWRWTHATNLSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 14 - protein, 497 aa, Trichoderma reesei
QSACTLQSETHPPLTWQKCSSGGTCTQQTGSVVIDANWRWTHATNTSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 15 - protein, 497 aa, Trichoderma reesei
QSACTLQSETHPPLTWQKCSSGGTCTQQTGSVVIDANWRWTHATNSSTNCIDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 16 - protein, 497 aa, Trichoderma reesei
QSACTLQSETHPPLTWQKCSSGGTCTQQTGSVVIDANWRWTHATNSSTNCYRGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 17 - protein, 497 aa, Trichoderma reesei
QSACTLQSETHPPLTWQKCSSGGTCTQQTGSVVIDANWRWTHATNSSTNCYTGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 18 - protein, 497 aa, Trichoderma reesei
QSACTLQSETHPPLTWQKCSSGGTCTQQTGSVVIDANWRWTHATNSSTNCYWGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 19 - protein, 497 aa, Trichoderma reesei
QSACTLQSETHPPLTWQKCSSGGTCTQQTGSVVIDANWRWTHATNSSTNCYDANTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 20 - protein, 497 aa, Trichoderma reesei
QSACTLQSETHPPLTWQKCSSGGTCTQQTGSVVIDANWRWTHATNSSTNCYDMNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 21 - protein, 497 aa, Trichoderma reesei
QSACTLQSETHPPLTWQKCSSGGTCTQQTGSVVIDANWRWTHATNSSTNCYDRNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 22 - protein, 497 aa, Trichoderma reesei
QSACTLQSETHPPLTWQKCSSGGTCTQQTGSVVIDANWRWTHATNSSTNCYDWNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 23 - protein, 497 aa, Trichoderma reesei
QSACTLQSETHPPLTWQKCSSGGTCTQQTGSVVIDANWRWTHATNSSTNCYDGDTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 24 - protein, 497 aa, Trichoderma reesei
QSACTLQSETHPPLTWQKCSSGGTCTQQTGSVVIDANWRWTHATNSSTNCYDGITWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 25 - protein, 497 aa, Trichoderma reesei
QSACTLQSETHPPLTWQKCSSGGTCTQQTGSVVIDANWRWTHATNSSTNCYDGSTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 26 - protein, 497 aa, Trichoderma reesei
QSACTLQSETHPPLTWQKCSSGGTCTQQTGSVVIDANWRWTHATNSSTNCYDGNTWSSALCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 27 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDSAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 28 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTTGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 29 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSVNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 30 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSVGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 31 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGLVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 32 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGYVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 33 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSGQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 34 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSLQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 35 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSTQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 36 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSVQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 37 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSWQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 38 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQRNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 39 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQSNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 40 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARIYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 41 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLTASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 42 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASETTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 43 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSSDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 44 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFEVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 45 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFNVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 46 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDADVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 47 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLSCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 48 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPSGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 49 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCELNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 50 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCMLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 51 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCQLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 52 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCRLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 53 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCSLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 54 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGGLYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 55 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGLLYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 56 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGAAYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 57 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGAVYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 58 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMNADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 59 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGMSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 60 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVGKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 61 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLLFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 62 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFNNGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 63 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFISGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 64 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGKANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 65 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWGPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 66 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEQSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 67 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSANANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 68 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSLNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 69 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSQNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 70 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSVNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 71 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSWNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 72 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNACTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 73 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNAFTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 74 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSSCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 75 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCTEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 76 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEIDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 77 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEASSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 78 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQETCEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 79 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGLGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 80 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGRGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 81 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGVGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 82 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGSYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 83 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSCNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 84 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSNNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 85 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYDGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 86 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYRGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 87 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDDCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 88 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWCPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 89 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWYPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 90 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNTYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 91 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNISFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 92 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFALDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 93 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFILDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 94 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTEKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 95 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGTINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 96 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTLQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 97 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQANAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 98 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNVELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 99 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGDELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 100 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNKLNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 101 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNEFNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 102 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELYDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 103 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCIAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 104 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFDGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 105 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSLSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 106 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTRFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 107 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFMKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 108 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKAASGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 109 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKAISGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 110 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSSGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 111 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVVSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 112 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWADYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 113 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWGDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 114 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDHYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 115 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYTNMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 116 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYAYMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 117 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANVLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 118 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMAWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 119 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLESTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 120 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDCTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 121 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDETYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 122 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYITNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 123 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYLTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 124 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYQTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 125 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPANETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 126 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPSNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 127 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNGTSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 128 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNITSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 129 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNLTSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 130 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTAGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 131 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTCGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 132 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTGGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 133 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTKGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 134 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTLGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 135 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTVGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 136 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTWGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 137 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAARGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 138 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCPTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 139 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTGSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 140 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAPVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 141 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQIESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 142 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFFNIKFGPIGSTGNPSGGNPPGGNPPGTTTTRRPATTTGSSPGPTQSHYGQCGGIGYSGPTVCASGTTCQVLNPYYSQCL

SEQ ID NO: 143 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSDIKFGPIGSTGNPSGGNPPGGNPPGTTTTRRPATTTGSSPGPTQSHYGQCGGIGYSGPTVCASGTTCQVLNPYYSQCL

SEQ ID NO: 144 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKYGPIGSTGNPSGGNPPGGNPPGTTTTRRPATTTGSSPGPTQSHYGQCGGIGYSGPTVCASGTTCQVLNPYYSQCL

SEQ ID NO: 145 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTDNPSGGNPPGGNPPGTTTTRRPATTTGSSPGPTQSHYGQCGGIGYSGPTVCASGTTCQVLNPYYSQCL

SEQ ID NO: 146 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGRPSGGNPPGGNPPGTTTTRRPATTTGSSPGPTQSHYGQCGGIGYSGPTVCASGTTCQVLNPYYSQCL

SEQ ID NO: 147 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGSNPPGGNPPGTTTTRRPATTTGSSPGPTQSHYGQCGGIGYSGPTVCASGTTCQVLNPYYSQCL

SEQ ID NO: 148 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGDPPGGNPPGTTTTRRPATTTGSSPGPTQSHYGQCGGIGYSGPTVCASGTTCQVLNPYYSQCL

SEQ ID NO: 149 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNTPGGNPPGTTTTRRPATTTGSSPGPTQSHYGQCGGIGYSGPTVCASGTTCQVLNPYYSQCL

SEQ ID NO: 150 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGDPPGTTTTRRPATTTGSSPGPTQSHYGQCGGIGYSGPTVCASGTTCQVLNPYYSQCL

SEQ ID NO: 151 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPDTTTTRRPATTTGSSPGPTQSHYGQCGGIGYSGPTVCASGTTCQVLNPYYSQCL

SEQ ID NO: 152 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGITTTRRPATTTGSSPGPTQSHYGQCGGIGYSGPTVCASGTTCQVLNPYYSQCL

SEQ ID NO: 153 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTATTRRPATTTGSSPGPTQSHYGQCGGIGYSGPTVCASGTTCQVLNPYYSQCL

SEQ ID NO: 154 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTSTRRPATTTGSSPGPTQSHYGQCGGIGYSGPTVCASGTTCQVLNPYYSQCL

SEQ ID NO: 155 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRSPATTTGSSPGPTQSHYGQCGGIGYSGPTVCASGTTCQVLNPYYSQCL

SEQ ID NO: 156 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPAITTGSSPGPTQSHYGQCGGIGYSGPTVCASGTTCQVLNPYYSQCL

SEQ ID NO: 157 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPASTTGSSPGPTQSHYGQCGGIGYSGPTVCASGTTCQVLNPYYSQCL

SEQ ID NO: 158 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATITGSSPGPTQSHYGQCGGIGYSGPTVCASGTTCQVLNPYYSQCL

SEQ ID NO: 159 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTQGSSPGPTQSHYGQCGGIGYSGPTVCASGTTCQVLNPYYSQCL

SEQ ID NO: 160 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSLGPTQSHYGQCGGIGYSGPTVCASGTTCQVLNPYYSQCL

SEQ ID NO: 161 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTKSHYGQCGGIGYSGPTVCASGTTCQVLNPYYSQCL

SEQ ID NO: 162 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTLSHYGQCGGIGYSGPTVCASGTTCQVLNPYYSQCL

SEQ ID NO: 163 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTSSHYGQCGGIGYSGPTVCASGTTCQVLNPYYSQCL

SEQ ID NO: 164 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHSGQCGGIGYSGPTVCASGTTCQVLNPYYSQCL

SEQ ID NO: 165 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYDQCGGIGYSGPTVCASGTTCQVLNPYYSQCL

SEQ ID NO: 166 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGSIGYSGPTVCASGTTCQVLNPYYSQCL

SEQ ID NO: 167 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYNGPTVCASGTTCQVLNPYYSQCL

SEQ ID NO: 168 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSDPTVCASGTTCQVLNPYYSQCL

SEQ ID NO: 169 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCANGTTCQVLNPYYSQCL

SEQ ID NO: 170 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASSTTCQVLNPYYSQCL

SEQ ID NO: 171 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASVTTCQVLNPYYSQCL

SEQ ID NO: 172 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTRQVLNPYYSQCL

SEQ ID NO: 173 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQDLNPYYSQCL

SEQ ID NO: 174 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVPNPYYSQCL

SEQ ID NO: 175 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVQNPYYSQCL

SEQ ID NO: 176 - protein, 497 aa, Trichoderma reesei
QSACTLQSETHPTLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFISGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 177 - protein, 497 aa, Trichoderma reesei
QSACTLQSETHPPLTWQKCSSGGTCAQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNTYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 178 - protein, 497 aa, Trichoderma reesei
QSACTLQSETHPPLTWQKCSSGGTCSQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQETCEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 179 - protein, 497 aa, Trichoderma reesei
QSACTLQSETHPPLTWQKCSSGGTCTQQTGSVVIDANWRWTHATDSSTNCYRGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 180 - protein, 497 aa, Trichoderma reesei
QSACTLQSETHPPLTWQKCSSGGTCTQQTGSVVIDANWRWTHATDSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFDGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 181 - protein, 497 aa, Trichoderma reesei
QSACTLQSETHPPLTWQKCSSGGTCTQQTGSVVIDANWRWTHATNSSTNCYDGITWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGSIGYSGPTVCASGTTCQVLNPYYSQCL

SEQ ID NO: 182 - protein, 497 aa, Trichoderma reesei
QSACTLQSETHPPLTWQKCSSGGTCTQQTGSVVIDANWRWTHATNSSTNCYDGSTWSSTLCPDNETCAKNCCLDGAAYASTYGVTTSGNSLSIGFVTQSAQKNVGARLYLMASDTTYQEFTLLGNEFSFEVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 183 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSVGFVTQSAQKNVGARLYLMASDTTYQEFTLLGNEFSFDADVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 184 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQRNVGARLYLMASDTTYQEFTLLGNEFSFNVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 185 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARIYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGDPPGGNPPGTTTTRRPATTTGSSPGPTQSHYGQCGGIGYSGPTVCASGTTCQVLNPYYSQCL

SEQ ID NO: 186 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLTASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGSNPPGGNPPGTTTTRRPATTTGSSPGPTQSHYGQCGGIGYSGPTVCASGTTCQVLNPYYSQCL

SEQ ID NO: 187 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLSCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFMKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 188 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGMSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTRQVLNPYYSQCL

SEQ ID NO: 189 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFNNGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTSTRRPATTTGSSPGPTQSHYGQCGGIGYSGPTVCASGTTCQVLNPYYSQCL

SEQ ID NO: 190 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGKANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTRFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 191 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYRGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTSSHYGQCGGIGYSGPTVCASGTTCQVLNPYYSQCL

SEQ ID NO: 192 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDDCDWNPYRLGNTSFYGPGSSFTLDTTKKLTVVTQFETSGAINRYYVQNGVTFQQPNAELGSYSGNELYDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 193 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFALDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATITGSSPGPTQSHYGQCGGIGYSGPTVCASGTTCQVLNPYYSQCL

SEQ ID NO: 194 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTEKLTVVTQFETSGAINRYYVQNGVTFQQPNAELGSYSGNELNDDYCTAEEAEFGGSSFSDKGGLTQFKKATSGGMVLVMSLWDDYYANMLWLDETYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 195 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCIAEEAEFGGSSFSDKGGLTQFKKATSGGMVLVVSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 196 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSSGMVLVMSLWDDYYANMLWLDSTYPTNETSSTCGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 197 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYTNMLWLDSTYPTNETSSTPGAARGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 198 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRSPATTTGSSPGPTQSHYGQCGGIGYSGPTVCANGTTCQVLNPYYSQCL

SEQ ID NO: 199 - protein, 497 aa, Trichoderma reesei
QSACTLQSETHPHLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSSGMVLVVSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 200 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASETTYQEFTLLGNEFSFDVDVSQLPCGLNGALYFVSMNADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPASTTGSSPGPTQSHYGQCGGIGYSGPTVCASGTTCQVLNPYYSQCL

SEQ ID NO: 201 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCTEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTLSHYGQCGGIGYSGPTVCASGTTCQDLNPYYSQCL

SEQ ID NO: 202 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFILDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTQGSSPGPTKSHYGQCGGIGYSGPTVCASGTTCQVLNPYYSQCL

SEQ ID NO: 203 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYAYMLWLDSTYPTNETSSTPGAVRGSCSTSSGVPAQIESQSPNAKVTFSNIKFGPIGSTGNPSGGNPPGGNPPGTTTTRRPATTTGSSLGPTQSHYGQCGGIGYSGPTVCASGTTCQVLNPYYSQCL

SEQ ID NO: 204 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSDIKFGPIGSTGNPSGGNPPGGNPPDTTTTRRPATTTGSSPGPTQSHYGQCGGIGYSGPTVCASGTTCQVPNPYYSQCL

SEQ ID NO: 205 - protein, 497 aa, Trichoderma reesei
QSACTLQSETHPPLTWQKCSSGGTCTQQTGSVVIDANWRWTHATNASTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWGPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTLQQPNAELGSYSGNELNDDYCTAEEAEFGGSSFSDKGGLTQFKKATSGGMVLVMSLWDDYYANMLWLDSTYPSNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 206 - protein, 497 aa, Trichoderma reesei
QSACILQSETHPPLTWQKCSSGGTCAQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNKLNDDYCTAEEAEFGGSSFSDKGGLTQFKKAISGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 207 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSSCSEMDIWEANSISEALTPHPCTTVGQEICEGDGCGGTYSDNRYGGTCDPDGCDWNTYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLESTYPTNETSSTPGAVRGSCSTSSGVPAQVESQSPNAKVTFSNIKFGPIGSTGNPSGGNPPGGNPPGITTTRRPATTTGSSPGPTQSHYGQCGGIGYSGPTVCASGTTCQVLNPYYSQCL

SEQ ID NO: 208 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEIDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAPVESQSPNAKVTFSNIKYGPIGSTGNPSGGNPPGGNPPGTATTRRPATTTGSSPGPTQSHYGQCGGIGYSGPTVCASGTTCQVLNPYYSQCL

SEQ ID NO: 209 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNVELGSYSGNELNDDYCTAEEAEFGGSSFSDKGGLTQFKKATSGGMVLVMSLWDDYYANMLWLDSTYPANETSSTPGAVRGSCSTSSGVPAQVESQSPNAKVTFSNIKFGPIGSTGNPSGGNTPGGNPPGTTTTRRPATTTGSSPGPTQSHYDQCGGIGYSGPTVCASGTTCQVLNPYYSQCL

SEQ ID NO: 210 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGDPPGTTTTRRPAITTGSSPGPTQSHYGQCGGIGYSGPTVCASSTTCQVQNPYYSQCL

SEQ ID NO: 211 - protein, 497 aa, Trichoderma reesei
QSACTLQSETHPPLTWQKCSSGGTCTQQTGSVVIDANWLWTHATNSSTNCYDGSTWSSTLCPDNETCAKNCCLDGAAYASTYGVTTSVNSLSIGFVTQSAQKNVGARLYLMASDTTYQEFTLLGNEFSSDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGSYSDNRYGGTCDPDGCDWNPYRLGNISFYGPGSSFTLDTTKKLTVVTQFETSGAINRYYVQNGVTFQQPNAELGSYSGDELNDDYCTAEEAEFGGSSFSDKGGLTQFKKATSGGMVLVMSLWDDYYANMLWLDSTYPTNETSSTPGAVRGSCPTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 212 - protein, 506 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASVTTCQVLNPYYSQCLYGTSSVAKA

SEQ ID NO: 213 - protein, 485 aa, Trichoderma reesei
QSACTLQSETHPPLTWQKCSSGGTCTQQTGSVVIDANWRWTHATNSSTNCYDGNTWSSALCPDNETCAKNCCLDGAAYASTYGVTTSGNSLSIGFVTQSAQKNVGARLYLMASDTTYQEFTLLGNEFSFDVDVSQLPCGLNGALYFVSMDADGGVGKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTT

SEQ ID NO: 214 - protein, 485 aa, Trichoderma reesei
QSACTLQSETHPPLTWQKCSSGGTCTQQTGSVVIDANWRWTHATNSSTNCYDGNTWSSTLCPDNETCAKNCCLDSAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTGSGVPAQVESQSPNAKVTFSNIKFGPIGSTGNPSGGNPPGGNPPGTTTTRRPATTTGSSPGPTQSHYGQCGGIGYSGPTVCASGTT

SEQ ID NO: 215 - protein, 510 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEQSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTGLRQRHNLPGPEPLLLSVPVRYQLRGESLTHR

SEQ ID NO: 216 - protein, 467 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSANANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYG

SEQ ID NO: 217 - protein, 488 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSNNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCRS

SEQ ID NO: 218 - protein, 509 aa, Myceliophthora thermophila
QNACTLTAENHPHLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 219 - protein, 509 aa, Myceliophthora thermophila
QNACTLTAENHPTLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 220 - protein, 509 aa, Myceliophthora thermophila
QNACTLTAENHPSLTWSKCTSDGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 221 - protein, 509 aa, Myceliophthora thermophila
QNACTLTAENHPSLTWSKCTSGGSCASVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 222 - protein, 509 aa, Myceliophthora thermophila
QNACTLTAENHPSLTWSKCTSGGSCSSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 223 - protein, 509 aa, Myceliophthora thermophila
QNACTLTAENHPSLTWSKCTSGGSCTLVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 224 - protein, 509 aa, Myceliophthora thermophila
QNACTLTAENHPSLTWSKCTSGGSCTSVQGSITIDANWLWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 225 - protein, 509 aa, Myceliophthora thermophila
QNACTLTAENHPSLTWSKCTSGGSCTSVQGSITIDANWRWTHRTDAATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 226 - protein, 509 aa, Myceliophthora thermophila
QNACTLTAENHPSLTWSKCTSGGSCTSVQGSITIDANWRWTHRTDGATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 227 - protein, 509 aa, Myceliophthora thermophila
QNACTLTAENHPSLTWSKCTSGGSCTSVQGSITIDANWRWTHRTDLATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 228 - protein, 509 aa, Myceliophthora thermophila
QNACTLTAENHPSLTWSKCTSGGSCTSVQGSITIDANWRWTHRTDTATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 229 - protein, 509 aa, Myceliophthora thermophila
QNACTLTAENHPSLTWSKCTSGGSCTSVQGSITIDANWRWTHRTDSATNCIEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 230 - protein, 509 aa, Myceliophthora thermophila
QNACTLTAENHPSLTWSKCTSGGSCTSVQGSITIDANWRWTHRTDSATNCYRGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 231 - protein, 509 aa, Myceliophthora thermophila
QNACTLTAENHPSLTWSKCTSGGSCTSVQGSITIDANWRWTHRTDSATNCYTGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 232 - protein, 509 aa, Myceliophthora thermophila
QNACTLTAENHPSLTWSKCTSGGSCTSVQGSITIDANWRWTHRTDSATNCYWGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 233 - protein, 509 aa, Myceliophthora thermophila
QNACTLTAENHPSLTWSKCTSGGSCTSVQGSITIDANWRWTHRTDSATNCYEANKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 234 - protein, 509 aa, Myceliophthora thermophila
QNACTLTAENHPSLTWSKCTSGGSCTSVQGSITIDANWRWTHRTDSATNCYEMNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 235 - protein, 509 aa, Myceliophthora thermophila
QNACTLTAENHPSLTWSKCTSGGSCTSVQGSITIDANWRWTHRTDSATNCYERNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 236 - protein, 509 aa, Myceliophthora thermophila
QNACTLTAENHPSLTWSKCTSGGSCTSVQGSITIDANWRWTHRTDSATNCYEWNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 237 - protein, 509 aa, Myceliophthora thermophila
QNACTLTAENHPSLTWSKCTSGGSCTSVQGSITIDANWRWTHRTDSATNCYEGDKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 238 - protein, 509 aa, Myceliophthora thermophila
QNACTLTAENHPSLTWSKCTSGGSCTSVQGSITIDANWRWTHRTDSATNCYEGIKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 239 - protein, 509 aa, Myceliophthora thermophila
QNACTLTAENHPSLTWSKCTSGGSCTSVQGSITIDANWRWTHRTDSATNCYEGSKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 240 - protein, 509 aa, Myceliophthora thermophila
QNACTLTAENHPSLTWSKCTSGGSCTSVQGSITIDANWRWTHRTDSATNCYEGNKWDTAYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 241 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDSADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 242 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTTGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 243 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSVNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 244 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNVKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 245 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKLVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 246 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKYVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 247 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQGSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 248 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQLSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 249 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQTSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 250 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQVSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 251 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQWSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 252 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSRNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 253 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSSNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 254 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRIYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 255 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLTESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 256 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESETKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 257 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTSDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 258 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFEVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 259 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFNVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 260 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDADVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 261 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLSCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 262 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGSGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 263 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCELNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 264 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCMLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 265 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCQLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 266 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCRLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 267 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCSLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 268 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGGLYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 269 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGLLYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 270 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGAAYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 271 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGAVYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 272 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMNADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 273 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMGKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 274 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLLFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 275 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFNNGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 276 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFISGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 277 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGKANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 278 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWGSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 279 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQQSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 280 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTADANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 281 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTLDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 282 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTQDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 283 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTVDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 284 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTWDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 285 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDACAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 286 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDAFAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 287 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSSCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 288 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCTEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 289 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEIDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 290 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEASNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 291 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSTCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 292 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGLSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 293 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGRSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 294 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGVSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 295 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGSYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 296 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSCDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 297 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSNDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 298 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYDGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 299 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYRGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 300 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDDCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 301 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFCSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 302 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFYSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 303 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNTYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 304 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNITFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 305 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMAVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 306 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMIVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 307 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTEKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 308 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSTGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 309 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVLPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 310 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNAESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 311 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSEVTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 312 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGDSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 313 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNKITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 314 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSFTQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 315 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSIYQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 316 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCIRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 317 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFDDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 318 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDLQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 319 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVRMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 320 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMMKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 321 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKAAAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 322 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKAIAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 323 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALASPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 324 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVVSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 325 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWADHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 326 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWGDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 327 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHATNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 328 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVYMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 329 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNVLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 330 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMAWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 331 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLESTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 332 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDCTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 333 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDETWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 334 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWIIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 335 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWLIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 336 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWQIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 337 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPADGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 338 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPSDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 339 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDIAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 340 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDLAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 341 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKAGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 342 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKCGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 343 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKGGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 344 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKKGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 345 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKLGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 346 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKVGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 347 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKWGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 348 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAARGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 349 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTGSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 350 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAPVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 351 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEIEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 352 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFFNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 353 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSDIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 354 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRYGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 355 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTDSGLPDGGSGNPNPPVSSSTPVPSSSTTSSGSSGPTGGTGVAKHYEQCGGIGFTGPTQCESPYTCTKLNDWYSQCL

SEQ ID NO: 356 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVRGLPDGGSGNPNPPVSSSTPVPSSSTTSSGSSGPTGGTGVAKHYEQCGGIGFTGPTQCESPYTCTKLNDWYSQCL

SEQ ID NO: 357 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGSSGNPNPPVSSSTPVPSSSTTSSGSSGPTGGTGVAKHYEQCGGIGFTGPTQCESPYTCTKLNDWYSQCL

SEQ ID NO: 358 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGDGNPNPPVSSSTPVPSSSTTSSGSSGPTGGTGVAKHYEQCGGIGFTGPTQCESPYTCTKLNDWYSQCL

SEQ ID NO: 359 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSTNPNPPVSSSTPVPSSSTTSSGSSGPTGGTGVAKHYEQCGGIGFTGPTQCESPYTCTKLNDWYSQCL

SEQ ID NO: 360 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPDPPVSSSTPVPSSSTTSSGSSGPTGGTGVAKHYEQCGGIGFTGPTQCESPYTCTKLNDWYSQCL

SEQ ID NO: 361 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPDSSSTPVPSSSTTSSGSSGPTGGTGVAKHYEQCGGIGFTGPTQCESPYTCTKLNDWYSQCL

SEQ ID NO: 362 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVISSTPVPSSSTTSSGSSGPTGGTGVAKHYEQCGGIGFTGPTQCESPYTCTKLNDWYSQCL

SEQ ID NO: 363 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSASTPVPSSSTTSSGSSGPTGGTGVAKHYEQCGGIGFTGPTQCESPYTCTKLNDWYSQCL

SEQ ID NO: 364 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPSPSSSTTSSGSSGPTGGTGVAKHYEQCGGIGFTGPTQCESPYTCTKLNDWYSQCL

SEQ ID NO: 365 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSISTTSSGSSGPTGGTGVAKHYEQCGGIGFTGPTQCESPYTCTKLNDWYSQCL

SEQ ID NO: 366 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSITTSSGSSGPTGGTGVAKHYEQCGGIGFTGPTQCESPYTCTKLNDWYSQCL

SEQ ID NO: 367 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSQTSSGSSGPTGGTGVAKHYEQCGGIGFTGPTQCESPYTCTKLNDWYSQCL

SEQ ID NO: 368 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSLGPTGGTGVAKHYEQCGGIGFTGPTQCESPYTCTKLNDWYSQCL

SEQ ID NO: 369 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVKKHYEQCGGIGFTGPTQCESPYTCTKLNDWYSQCL

SEQ ID NO: 370 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVLKHYEQCGGIGFTGPTQCESPYTCTKLNDWYSQCL

SEQ ID NO: 371 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVSKHYEQCGGIGFTGPTQCESPYTCTKLNDWYSQCL

SEQ ID NO: 372 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHSEQCGGIGFTGPTQCESPYTCTKLNDWYSQCL

SEQ ID NO: 373 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYDQCGGIGFTGPTQCESPYTCTKLNDWYSQCL

SEQ ID NO: 374 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGSIGFTGPTQCESPYTCTKLNDWYSQCL

SEQ ID NO: 375 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFNGPTQCESPYTCTKLNDWYSQCL

SEQ ID NO: 376 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTDPTQCESPYTCTKLNDWYSQCL

SEQ ID NO: 377 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCENPYTCTKLNDWYSQCL

SEQ ID NO: 378 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESSYTCTKLNDWYSQCL

SEQ ID NO: 379 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESVYTCTKLNDWYSQCL

SEQ ID NO: 380 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTRTKLNDWYSQCL

SEQ ID NO: 381 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTDLNDWYSQCL

SEQ ID NO: 382 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKPNDWYSQCL

SEQ ID NO: 383 - protein, 509 aa, Myceliophthora thermophila
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCTVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDFQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKQNDWYSQCL

SEQ ID NO: 384 - DNA, 1677 bp, Artificial
  Gene sequence with flanking sequences
catgtatcggaagttggccgtcatctcggccttcttggccacagctcgtgctcagtcggcctgcactctccaatcggagactcacccgcctctgacatggcagaaatgctcgtctggtggcacgtgcactcaacagacaggctccgtggtcatcgacgccaactggcgctggactcacgctacgaacagcagcacgaactgctacgatggcaacacttggagctcgaccctatgtcctgacaacgagacctgcgcgaagaactgctgtctggacggtgccgcctacgcgtccacgtacggagttaccacgagcggtaacagcctctccattggctttgtcacccagtctgcgcagaagaacgttggcgctcgcctttaccttatggcgagcgacacgacctaccaggaattcaccctgcttggcaacgagttctctttcgatgttgatgtttcgcagctgccgtaagtgacttaccatgaacccctgacgctatcttcttgttggctcccagctgactggccaattcaaggtgcggcttgaacggagctctctacttcgtgtccatggacgcggatggtggcgtgagcaagtatcccaccaacaccgctggcgccaagtacggcacggggtactgtgacagccagtgtccccgcgatctgaagttcatcaatggccaggccaacgttgagggctgggagccgtcatccaacaacgcgaacacgggcattggaggacacggaagctgctgctctgagatggatatctgggaggccaactccatctccgaggctcttaccccccacccttgcacgactgtcggccaggagatctgcgagggtgatgggtgcggcggaacttactccgataacagatatggcggcacttgcgatcccgatggctgcgactggaacccataccgcctgggcaacaccagcttctacggccctggctcaagctttaccctcgataccaccaagaaattgaccgttgtcacccagttcgagacgtcgggtgccatcaaccgatactatgtccagaatggcgtcactttccagcagcccaacgccgagcttggtagttactctggcaacgagctcaacgatgattactgcacagctgaggaggcagaattcggcggatcctctttctcagacaagggcggcctgactcagttcaagaaggctacctctggcggcatggttctggtcatgagtctgtgggatgatgtgagtttgatggacaaacatgcgcgttgacaaagagtcaagcagctgactgagatgttacagtactacgccaacatgctgtggctggactccacctacccgacaaacgagacctcctccacacccggtgccgtgcgcggaagctgctccaccagctccggtgtccctgctcaggtcgaatctcagtctcccaacgccaaggtcaccttctccaacatcaagttcggacccattggcagcaccggcaaccctagcggcggcaaccctcccggcggaaacccgcctggcaccaccaccacccgccgcccagccactaccactggaagctctcccggacctacccagtctcactacggccagtgcggcggtattggctacagcggccccacggtctgcgccagcggcacaacttgccaggtcctgaacccttactactctcagtgcctgtaa

SEQ ID NO: 385 - DNA, 1677 bp, Artificial
  Gene sequence with flanking sequences
catgtatcggaagttggccgtcatctcggccttcttggccacagctcgtgctcagtcggcctgcactctccaatcggagactcacccgcctctgacatggcagaaatgctcgtctggtggcacgtgcactcaacagacaggctccgtggtcatcgacgccaactggcgctggactcacgctacgaacagcagcacgaactgctacgatggcaacacttggagctcgaccctatgtcctgacaacgagacctgcgcgaagaactgctgtctggacggtgccgcctacgcgtccacgtacggagttaccacgagcggtaacagcctctccattggctttgtcacccagtctgcgcagaagaacgttggcgctcgcctttaccttatggcgagcgacacgacctaccaggaattcaccctgcttggcaacgagttctctttcgatgttgatgtttcgcagctgccgtaagtgacttaccatgaacccctgacgctatcttcttgttggctcccagctgactggccaattcaaggtgcggcttgaacggagctctctacttcgtgtccatggacgcggatggtggcgtgagcaagtatcccaccaacaccgctggcgccaagtacggcacggggtactgtgacagccagtgtccccgcgatctgaagttcatcaatggccaggccaacgttgagggctgggagccgtcatccaacaacgcgaacacgggcattggaggacacggaagctgctgctctgagatggatatctgggaggccaactccatctccgaggctcttaccccccacccttgcacgactgtcggccaggagatctgcgagggtgatgggtgcggcggaacttactccgataacagatatggcggcacttgcgatcccgatggctgcgactggaacccataccgcctgggcaacaccagcttctacggccctggctcaagctttaccctcgataccaccaagaaattgaccgttgtcacccagttcgagacgtcgggtgccatcaaccgatactatgtccagaatggcgtcactttccagcagcccaacgccgagcttggtagttactctggcaacgagctcaacgatgattactgcacagctgaggaggcagaattcggcggatcctctttctcagacaagggcggcctgactcagttcaagaaggctacctctggcggcatggttctggtcatgagtctgtgggatgatgtgagtttgatggacaaacatgcgcgttgacaaagagtcaagcagctgactgagatgttacagtactacgccaacatgctgtggctggactccacctacccgacaaacgagacctcctccacacccggtgccgtgcgcggaagctgctccaccagctccggtgtccctgctcaggtcgaatctcagtctcccaacgccaaggtcaccttctccaacatcaagttcggacccattggcagcaccggcaaccctagcggcggcaaccctcccggcggaaacccgcctggcaccaccaccaccgaggagccagccactaccactggaagctctcccggacctacccagtctcactacggccagtgcggcggtattggctacagcggccccacggtctgcgccagcggcacaacttgccaggtcctgaacccttactactctcagtgcctgtaa

SEQ ID NO: 386 - DNA, 41 bp, Artificial
  Primer sequence
gcggactgcgcatcgctagcatgtatcggaagttggccgtc

SEQ ID NO: 387 - DNA, 43 bp, Artificial
  Primer sequence
ttcgccacggagctggtaccttacaggcactgagagtagtaag

SEQ ID NO: 388 - DNA, 19 bp, Artificial
  Primer sequence
gttcgtagcgtgagtccag

SEQ ID NO: 389 - DNA, 41 bp, Artificial
  Primer sequence
  misc_feature (20)..(21): n is a, c, g, or t
ctggactcacgctacgaacnnsagcacgaactgctacgatg

SEQ ID NO: 390 - DNA, 23 bp, Artificial
  Primer sequence
gtagcagttcgtgctgctgttcg

SEQ ID NO: 391 - DNA, 48 bp, Artificial
  Primer sequence
  misc_feature (24)..(25): n is a, c, g, or t
cgaacagcagcacgaactgctacnnsggcaacacttggagctcgaccc

SEQ ID NO: 392 - DNA, 25 bp, Artificial
  Primer sequence
atcgtagcagttcgtgctgctgttc

SEQ ID NO: 393 - DNA, 46 bp, Artificial
  Primer sequence
  misc_feature (26)..(27): n is a, c, g, or t
gaacagcagcacgaactgctacgatnnsaacacttggagctcgacc

SEQ ID NO: 394 - DNA, 16 bp, Artificial
  Primer sequence
gccaatggagaggctg

SEQ ID NO: 395 - DNA, 43 bp, Artificial
  Primer sequence
  misc_feature (17)..(18): n is a, c, g, or t
cagcctctccattggcnnsgtcacccagtctgcgcagaagaac

SEQ ID NO: 396 - DNA, 22 bp, Artificial
  Primer sequence
agactgggtgacaaagccaatg

SEQ ID NO: 397 - DNA, 44 bp, Artificial
  Primer sequence
  misc_feature (23)..(24): n is a, c, g, or t
cattggctttgtcacccagtctnnscagaagaacgttggcgctc

SEQ ID NO: 398 - DNA, 22 bp, Artificial
  Primer sequence
ctgcgcagactgggtgacaaag

SEQ ID NO: 399 - DNA, 47 bp, Artificial
  Primer sequence
  misc_feature (23)..(24): n is a, c, g, or t
ctttgtcacccagtctgcgcagnnsaacgttggcgctcgcctttacc

SEQ ID NO: 400 - DNA, 18 bp, Artificial
  Primer sequence
gcaccttgaattggccag

SEQ ID NO: 401 - DNA, 39 bp, Artificial
  Primer sequence
  misc_feature (19)..(20): n is a, c, g, or t
ctggccaattcaaggtgcnnsttgaacggagctctctac

SEQ ID NO: 402 - DNA, 20 bp, Artificial
  Primer sequence
tccgttcaagccgcaccttg

SEQ ID NO: 403 - DNA, 46 bp, Artificial
  Primer sequence
  misc_feature (21)..(22): n is a, c, g, or t
caaggtgcggcttgaacggannsctctacttcgtgtccatggacgc

SEQ ID NO: 404 - DNA, 17 bp, Artificial
  Primer sequence
agctccgttcaagccgc

SEQ ID NO: 405 - DNA, 42 bp, Artificial
  Primer sequence
  misc_feature (18)..(19): n is a, c, g, or t
gcggcttgaacggagctnnstacttcgtgtccatggacgcgg

SEQ ID NO: 406 - DNA, 18 bp, Artificial
  Primer sequence
cagatcgcggggacactg

SEQ ID NO: 407 - DNA, 42 bp, Artificial
  Primer sequence
  misc_feature (19)..(20): n is a, c, g, or t
cagtgtccccgcgatctgnnsttcatcaatggccaggccaac

SEQ ID NO: 408 - DNA, 16 bp, Artificial
  Primer sequence
ggatgacggctcccag

SEQ ID NO: 409 - DNA, 38 bp, Artificial
  Primer sequence
  misc_feature (17)..(18): n is a, c, g, or t
ctgggagccgtcatccnnsaacgcgaacacgggcattg

SEQ ID NO: 410 - DNA, 17 bp, Artificial
  Primer sequence
cgcgttgttggatgacg

SEQ ID NO: 411 - DNA, 38 bp, Artificial
  Primer sequence
  misc_feature (18)..(19): n is a, c, g, or t
cgtcatccaacaacgcgnnsacgggcattggaggacac

SEQ ID NO: 412 - DNA, 16 bp, Artificial
  Primer sequence
ggcctcccagatatcc

SEQ ID NO: 413 - DNA, 39 bp, Artificial
  Primer sequence
  misc_feature (17)..(18): n is a, c, g, or t
ggatatctgggaggccnnstccatctccgaggctcttac

SEQ ID NO: 414 - DNA, 19 bp, Artificial
  Primer sequence
accctcgcagatctcctgg

SEQ ID NO: 415 - DNA, 40 bp, Artificial
  Primer sequence
  misc_feature (20)..(21): n is a, c, g, or t
ccaggagatctgcgagggtnnsgggtgcggcggaacttac

SEQ ID NO: 416 - DNA, 21 bp, Artificial
  Primer sequence
ggagtaagttccgccgcaccc

SEQ ID NO: 417 - DNA, 44 bp, Artificial
  Primer sequence
  misc_feature (22)..(23): n is a, c, g, or t
gggtgcggcggaacttactccnnsaacagatatggcggcacttg

SEQ ID NO: 418 - DNA, 23 bp, Artificial
  Primer sequence
atatctgttatcggagtaagttc

SEQ ID NO: 419 - DNA, 45 bp, Artificial
  Primer sequence
  misc_feature (24)..(25): n is a, c, g, or t
gaacttactccgataacagatatnnsggcacttgcgatcccgatg

SEQ ID NO: 420 - DNA, 18 bp, Artificial
  Primer sequence
atcgggatcgcaagtgcc

SEQ ID NO: 421 - DNA, 39 bp, Artificial
  Primer sequence
  misc_feature (19)..(20): n is a, c, g, or t
ggcacttgcgatcccgatnnstgcgactggaacccatac

SEQ ID NO: 422 - DNA, 16 bp, Artificial
  Primer sequence
ccagtcgcagccatcg

SEQ ID NO: 423 - DNA, 42 bp, Artificial
  Primer sequence
  misc_feature (17)..(18): n is a, c, g, or t
cgatggctgcgactggnnsccataccgcctgggcaacaccag

SEQ ID NO: 424 - DNA, 20 bp, Artificial
  Primer sequence
gagctcgttgccagagtaac

SEQ ID NO: 425 - DNA, 45 bp, Artificial
  Primer sequence
  misc_feature (21)..(22): n is a, c, g, or t
gttactctggcaacgagctcnnsgatgattactgcacagctgagg

SEQ ID NO: 426 - DNA, 20 bp, Artificial
  Primer sequence
agaggatccgccgaattctg

SEQ ID NO: 427 - DNA, 43 bp, Artificial
  Primer sequence
  misc_feature (21)..(22): n is a, c, g, or t
cagaattcggcggatcctctnnstcagacaagggcggcctgac

SEQ ID NO: 428 - DNA, 18 bp, Artificial
  Primer sequence
ccacagactcatgaccag

SEQ ID NO: 429 - DNA, 39 bp, Artificial
  Primer sequence
  misc_feature (19)..(20): n is a, c, g, or t
ctggtcatgagtctgtggnnsgatgtgagtttgatggac

SEQ ID NO: 430 - DNA, 19 bp, Artificial
  Primer sequence
gttggcgtagtactgtaac

SEQ ID NO: 431 - DNA, 40 bp, Artificial
  Primer sequence
  misc_feature (20)..(21): n is a, c, g, or t
gttacagtactacgccaacnnsctgtggctggactccacc

SEQ ID NO: 432 - DNA, 18 bp, Artificial
  Primer sequence
catgttggcgtagtactg

SEQ ID NO: 433 - DNA, 39 bp, Artificial
  Primer sequence
  misc_feature (19)..(20): n is a, c, g, or t
cagtactacgccaacatgnnstggctggactccacctac

SEQ ID NO: 434 - DNA, 19 bp, Artificial
  Primer sequence
gtccagccacagcatgttg

SEQ ID NO: 435 - DNA, 40 bp, Artificial
  Primer sequence
  misc_feature (20)..(21): n is a, c, g, or t
caacatgctgtggctggacnnsacctacccgacaaacgag

SEQ ID NO: 436 - DNA, 21 bp, Artificial
  Primer sequence
gtaggtggagtccagccacag

SEQ ID NO: 437 - DNA, 42 bp, Artificial
  Primer sequence
  misc_feature (22)..(23): n is a, c, g, or t
ctgtggctggactccacctacnnsacaaacgagacctcctcc

SEQ ID NO: 438 - DNA, 19 bp, Artificial
  Primer sequence
gtttgtcgggtaggtggag

SEQ ID NO: 439 - DNA, 42 bp, Artificial
  Primer sequence
  misc_feature (20)..(21): n is a, c, g, or t
ctccacctacccgacaaacnnsacctcctccacacccggtgc

SEQ ID NO: 440 - DNA, 20 bp, Artificial
  Primer sequence
tgtggaggaggtctcgtttg

SEQ ID NO: 441 - DNA, 40 bp, Artificial
  Primer sequence
  misc_feature (21)..(22): n is a, c, g, or t
caaacgagacctcctccacannsggtgccgtgcgcggaag

SEQ ID NO: 442 - DNA, 1585 bp, Artificial
  Gene sequence with flanking sequences
gcggactgcgcatcgctagcatgtatcggaagttggccgtcatctcggccttcttggccacagctcgtgctcagtcggcctgcactctccaatcggagactcacccgcctctgacatggcagaaatgctcgtctggtggcacgtgcactcaacagacaggctccgtggtcatcgacgccaactggcgctggactcacgctacgaacagcagcacgaactgctacgatggcaacacttggagctcgaccctatgtcctgacaacgagacctgcgcgaagaactgctgtctggacggtgccgcctacgcgtccacgtacggagttaccacgagcggtaacagcctctccattggctttgtcacccagtctgcgcagaagaacgttggcgctcgcctttaccttatggcgagcgacacgacctaccaggaattcaccctgcttggcaacgagttctctttcgatgttgatgtttcgcagctgccgtgcggcttgaacggagctctctacttcgtgtccatggacgcggatggtggcgtgagcaagtatcccaccaacaccgctggcgccaagtacggcacggggtactgtgacagccagtgtccccgcgatctgaagttcatcaatggccaggccaacgttgagggctgggagccgtcatccaacaacgcgaacacgggcattggaggacacggaagctgctgctctgagatggatatctgggaggccaactccatctccgaggctcttaccccccacccttgcacgactgtcggccaggagatctgcgagggtgatgggtgcggcggaacttactccgataacagatatggcggcacttgcgatcccgatggctgcgactggaacccataccgcctgggcaacaccagcttctacggccctggctcaagctttaccctcgataccaccaagaaattgaccgttgtcacccagttcgagacgtcgggtgccatcaaccgatactatgtccagaatggcgtcactttccagcagcccaacgccgagcttggtagttactctggcaacgagctcaacgatgattactgcacagctgaggaggcagaattcggcggatcctctttctcagacaagggcggcctgactcagttcaagaaggctacctctggcggcatggttctggtcatgagtctgtgggatgattactacgccaacatgctgtggctggactccacctacccgacaaacgagacctcctccacacccggtgccgtgcgcggaagctgctccaccagctccggtgtccctgctcaggtcgaatctcagtctcccaacgccaaggtcaccttctccaacatcaagttcggacccattggcagcaccggcaaccctagcggcggcaaccctcccggcggaaacccgcctggcaccaccaccaccgaggagccagccactaccactggaagctctcccggacctacccagtctcactacggccagtgcggcggtattggctacagcggccccacggtctgcgccagcggcacaacttgccaggtcctgaacccttactactctcagtgcctgtaaggtaccagctccgtggcgaa

SEQ ID NO: 443 - DNA, 1585 bp, Artificial
  Gene sequence with flanking sequences
gcggactgcgcatcgctagcatgtatcggaagttggccgtcatctcggccttcttggccacagctcgtgctcagtcggcctgcactctccaatcggagactcacccgcctctgacatggcagaaatgctcgtctggtggcacgtgcactcaacagacaggctccgtggtcatcgacgccaactggcgctggactcacgctacgaacagcagcacgaactgctacgatggcaacacttggagctcgaccctatgtcctgacaacgagacctgcgcgaagaactgctgtctggacggtgccgcctacgcgtccacgtacggagttaccacgagcggtaacagcctctccattggctttgtcacccagtctgcgcagaagaacgttggcgctcgcctttaccttatggcgagcgacacgacctaccaggaattcaccctgcttggcaacgagttctctttcgatgttgatgtttcgcagctgccgtgcggcttgaacggagctctctacttcgtgtccatggacgcggatggtggcgtgagcaagtatcccaccaacaccgctggcgccaagtacggcacggggtactgtgacagccagtgtccccgcgatctgaagttcatcaatggccaggccaacgttgagggctgggagccgtcatccaacaacgcgaacacgggcattggaggacacggaagctgctgctctgagatggatatctgggaggccaactccatctccgaggctcttaccccccacccttgcacgactgtcggccaggagatctgcgagggtgatgggtgcggcggaacttactccgataacagatatggcggcacttgcgatcccgatggctgcgactggaacccataccgcctgggcaacaccagcttctacggccctggctcaagctttaccctcgataccaccaagaaattgaccgttgtcacccagttcgagacgtcgggtgccatcaaccgatactatgtccagaatggcgtcactttccagcagcccaacgccgagcttggtagttactctggcaacgagctcaacgatgattactgcacagctgaggaggcagaattcggcggatcctctttctcagacaagggcggcctgactcagttcaagaaggctacctctggcggcatggttctggtcatgagtctgtgggatgattactacgccaacatgctgtggctggactccacctacccgacaaacgagacctcctccacacccggtgccgtgcgcggaagctgctccaccagctccggtgtccctgctcaggtcgaatctcagtctcccaacgccaaggtcaccttctccaacatcaagttcggacccattggcagcaccggcaaccctagcggcggcaaccctcccggcggaaacccgcctggcaccaccaccacccgccgcccagccactaccactggaagctctcccggacctacccagtctcactacggccagtgcggcggtattggctacagcggccccacggtctgcgccagcggcacaacttgccaggtcctgaacccttactactctcagtgcctgtaaggtaccagctccgtggcgaa

SEQ ID NO: 444 - DNA, 18 bp, Artificial
  Primer sequence
aagccgatgtcacacgcg

SEQ ID NO: 445 - DNA, 20 bp, Artificial
  Primer sequence
cagatcctccaggagacttg

SEQ ID NO: 446 - protein, 497 aa, Trichoderma reesei
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTEEPATTTGSSPGPTQSHYGQCGGIGYSGPTVCASGTTCQVLNPYYSQCL

SEQ ID NO: 447 - protein, 436 aa, Artificial sequence
  Synthetic construct
QQAGTLTAETHPSLTWQKCTSGGSCTTVNGSVVIDANWRWTHTTNGSTNCYTGNTWDTSICPDGETCAQNCALDGADYSSTYGVTTSGNSLTLKFVTQSSQKNVGSRLYLMADDTKYQMFTLLNNEFTFDVDVSNLPCGLNGALYFVSMDADGGMSKYPTNKAGAKYGTGYCDSQCPRDLKFINGQANVEGWEPSSNDANAGIGNHGSCCAEMDIWEANSISTAFTPHPCTTVGQTRCEGDSCGGTYSSDRYAGTCDPDGCDFNPYRMGNTTFYGPGTVDTTKKFTVVTQFLTNDGTLSEIKRFYVQNGKVIPNSESTIPGVSGNSITDDFCTAQKTAFGDTNSFADKGGLAQMGKALAGGMVLVMSLWDDHAANMLWLDSTYPTDADASTPGAARGTCPTTSGVPADVESQSPNAYVVFSNIKFGPIGSTFTGTG

SEQ ID NO: 448 - protein, 436 aa, Hypocrea koningii
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGN

SEQ ID NO: 449 - protein, 436 aa, Hypocrea rufa
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWDPYRLGNTSFYGPGSSFTLDTTKKLTVVTQFETSGAINRYYVQNGVTFQQPNAELGSYSGNGLNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGDPSGGN

SEQ ID NO: 450 - protein, 436 aa, Hypocrea rufa; identical to SEQ ID NO: 449

SEQ ID NO: 451 - protein, 436 aa, Hypocrea rufa; identical to SEQ ID NO: 449

SEQ ID NO: 452 - protein, 435 aa, Aspergilus niger
QQAGTLTEEVHPSLTWQKCTSEGSCTEQSGSVVIDSNWRWTHSVNDSTNCYTGNTWDATLCPDDETCAANCALDGADYESTYGVTTDGDSLTLKFVTGSNVGSRLYLMDTSDEGYQTFNLLDAEFTFDVDVSNLPCGLNGALYFTAMDADGGVSKYPANKAGAKYGTGYCDSQCPRDLKFIDGQANVDGWEPSSNNDNTGIGNHGSCCPEMDIWEANKISTALTPHPCDSSEQTMCEGNDCGGTYSDDRYGGTCDPDGCDFNPYRMGNDSFYGPGKTIDTGSKMTVVTQFITDGSGSLSEIKRYYVQNGNVIANADSNISGVTGNSITTDFCTAQKKAFGDEDIFAEHNGLAGISDAMSSMVLILSLWDDYYASMEWLDSDYPENATATDPGVARGTCDSESGVPATVEGAHPDSSVTFSNIKFGPINSTFSASA

SEQ ID NO: 453 - protein, 437 aa, Talaromyces emersonii
QQAGTATAENHPPLTWQECTAPGSCTTQNGAVVLDANWRWVHDVNGYTNCYTGNTWDPTYCPDDETCAQNCALDGADYEGTYGVTSSGSSLKLNFVTGSNVGSRLYLLQDDSTYQIFKLLNREFSFDVDVSNLPCGLNGALYFVAMDADGGVSKYPNNKAGAKYGTGYCDSQCPRDLKFIDGEANVEGWQPSSNNANTGIGDHGSCCAEMDVWEANSISNAVTPHPCDTPGQTMCSGDDCGGTYSNDRYAGTCDPDGCDFNPYRMGNTSFYGPGKIIDTTKPFTVVTQFLTDDGTDTGTLSEIKRFYIQNSNVIPQPNSDISGVTGNSITTEFCTAQKQAFGDTDDFSQHGGLAKMGAAMQQGMVLVMSLWDDYAAQMLWLDSDYPTDADPTTPGIARGTCPTDSGVPSDVESQSPNSYVTYSNIKFGPINSTFTAS

SEQ ID NO: 454 - protein, 440 aa, Thermoascus aurantiacus
QQAGTVTAENHPSLTWQQCSSGGSCTTQNGKVVIDANWRWVHTTSGYTNCYTGNTWDTSICPDDVTCAQNCALDGADYSGTYGVTTSGNALRLNFVTQSSGKNIGSRLYLLQDDTTYQIFKLLGQEFTFDVDVSNLPCGLNGALYFVAMDADGGLSKYPGNKAGAKYGTGYCDSQCPRDLKFINGQANVEGWQPSANDPNAGVGNHGSCCAEMDVWEANSISTAVTPHPCDTPGQTMCQGDDCGGTYSSTRYAGTCDPDGCDFNPYRQGNHSFYGPGQIVDTSSKFTVVTQFITDDGTPSGTLTEIKRFYVQNGKVIPQSESTISGVTGNSITTEYCTAQKAAFGDNTGFFTHGGLQKISQALAQGMVLVMSLWDDHAANMLWLDSTYPTDADPDTPGVARGTCPTTSGVPADVESQYPNSYVIYSNIKVGPINSTFTAN

SEQ ID NO: 455 - protein, 441 aa, Penicillium occitanis
QQIGTYTAETHPSLSWSTCKSGGSCTTNSGAITLDANWRWVHGVNTSTNCYTGNTWNSAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSANNANTGIGNHGACCAELDIWEANSISEALTPHPCDTPGLSVCTTDACGGTYSSDRYAGTCDPDGCDFNPYRLGVTDFYGSGKTVDTTKPFTVVTQFVTNDGTSTGSLSEIRRYYVQNGVVIPQPSSKISGISGNVINSDYCAAEISTFGGTASFNKHGGLTNMAAGMEAGMVLVMSLWDDYAVNMLWLDSTYPTNATGTPGAARGTCATTSGDPKTVESQSGSSYVTFSDIRVGPFNSTFSGGSSTGG

SEQ ID NO: 456 - protein, 440 aa, Thermoascus aurantiacus
HEAGTVTAENHPSLTWQQCSSGGSCTTQNGKVVIDANWRWVHTTSGYTNCYTGNTWDTSICPDDVTCAQNCALDGADYSGTYGVTTSGNALRLNFVTQSSGKNIGSRLYLLQDDTTYQIFKLLGQEFTFDVDVSNLPCGLNGALYFVAMDADGNLSKYPGNKAGAKYGTGYCDSQCPRDLKFINGQANVEGWQPSANDPNAGVGNHGSSCAEMDVWEANSISTAVTPHPCDTPGQTMCQGDDCGGTYSSTRYAGTCDPDGCDFNPYQPGNHSFYGPGKIVDTSSKFTVVTQFITDDGTPSGTLTEIKRFYVQNGKVIPQSESTISGVTGNSITTEYCTAQKAAFGDNTGFFTHGGLQKISQALAQGMVLVMSLWDDHAANMLWLDSTYPTDADPDTPGVARGTCPTTSGVPADVESQNPNSYVIYSNIKVGPINSTFTAN

SEQ ID NO: 457 - protein, 441 aa, Acremonium thermophilum
QAACSLTAETHPSLQWQKCTAPGSCTTVSGQVTIDANWRWLHQTNSSTNCYTGNEWDTSICSSDTDCATKCCLDGADYTGTYGVTASGNSLNLKFVTQGPYSKNIGSRMYLMESESKYQGFTLLGQEFTFDVDVSNLGCGLNGALYFVSMDLDGGVSKYTTNKAGAKYGTGYCDSQCPRDLKFINGQANIDGWQPSSNDANAGLGNHGSCCSEMDIWEANKVSAAYTPHPCTTIGQTMCTGDDCGGTYSSDRYAGICDPDGCDFNSYRMGDTSFYGPGKTVDTGSKFTVVTQFLTGSDGNLSEIKRFYVQNGKVIPNSESKIAGVSGNSITTDFCTAQKTAFGDTNVFEERGGLAQMGKALAEPMVLVLSVWDDHAVNMLWLDSTYPTDSTKPGAARGDCPITSGVPADVESQAPNSNVIYSNIRFGPINSTYTGTPSGGN

SEQ ID NO: 458 - protein, 442 aa, Penicillium funiculosum
QQIGTYTAETHPSLSWSTCKSGGSCTTNSGAITLDANWRWVHGVNTSTNCYTGNTWNTAICDTDASCAQDCALDGADYSGTYGITTSGNSLRLNFVTGSNVGSRTYLMADNTHYQIFDLLNQEFTFTVDVSNLPCGLNGALYFVTMDADGGVSKYPNNKAGAQYGVGYCDSQCPRDLKFIAGQANVEGWTPSTNNSNTGIGNHGSCCAELDIWEANSISEALTPHPCDTPGLTVCTADDCGGTYSSNRYAGTCDPDGCDFNPYRLGVTDFYGSGKTVDTTKPFTVVTQFVTDDGTSSGSLSEIRRYYVQNGVVIPQPSSKISGISGNVINSDFCAAELSAFGETASFTNHGGLKNMGSALEAGMVLVMSLWDDYSVNMLWLDSTYPANETGTPGAARGSCPTTSGNPKTVESQSGSSYVVFSDIKVGPFNSTFSGGTSTGGT

SEQ ID NO: 459 - protein, 448 aa, Aspergillus niger
AQQVGTYTTETHPSLTWQTCTSDGSCTTNDGEVVIDANWRWVHSTSSATNCYTGNEWDTSICTDDVTCAANCALDGATYEATYGVTTSGSELRLNFVTQGSSKNIGSRLYLMSDDSNYELFKLLGQEFTFDVDVSNLPCGLNGALYFVAMDADGGTSEYSGNKAGAKYGTGYCDSQCPRDLKFINGEANCDGWEPSSNNVNTGVGDHGSCCAEMDVWEANSISNAFTAHPCDSVSQTMCDGDSCGGTYSASGDRYSGTCDPDGCDYNPYRLGNTDFYGPGLTVDTNSPFTVVTQFITDDGTSSGTLTEIKRLYVQNGEVIANGASTYSSVNGSSITSAFCESEKTLFGDENVFDKHGGLEGMGEAMAKGMVLVLSLWDDYAADMLWLDSDYPVNSSASTPGVARGTCSTDSGVPATVEAESPNAYVTYSNIKFGPIGSTYSSGSSSGS

SEQ ID NO: 460 - protein, 442 aa, Penicillium janthinellum Biourge
  misc_feature (23)..(23): Xaa can be any naturally occurring amino acid
  misc_feature (39)..(39): Xaa can be any naturally occurring amino acid
QQVGTLTAETHPALTWSKCTAGXCSQVSGSVVIDANWPXVHSTSGSTNCYTGNTWDATLCPDDVTCAANCAVDGARRQHLRVTTSGNSLRINFVTTASQKNIGSRLYLLENDTTYQKFNLLNQEFTFDVDVSNLPCGLNGALYFVDMDADGGMAKYPTNKAGAKYGTGYCDSQCPRDLKFINGQANVDGWTPSKNDVNSGIGNHGSCCAEMDIWEANSISNAVTPHPCDTPSQTMCTGQRCGGTYSTDRYGGTCDPDGCDFNPYRMGVTNFYGPGETIDTKSPFTVVTQFLTNDGTSTGTLSEIKRFYVQGGKVIGNPQSTIVGVSGNSITDSWCNAQKSAFGDTNEFSKHGGMAGMGAGLADGMVLVMSLWDDHASDMLWLDSTYPTNATSTTPGAKRGTCDISRRPNTVESTYPNAYVIYSNIKTGPLNSTFTGGTTSSS

SEQ ID NO: 461 - protein, 441 aa, Chrysosporium lucknowense
  misc_feature (232)..(232): Xaa can be any naturally occurring amino acid
  misc_feature (348)..(348): Xaa can be any naturally occurring amino acid
QNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCXVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDXQDKGGMVQMGKALAGPMVLVMSIWDDHAVNMLWLDSTWPIDGAGKPGAERGACPTTSGVPAEVEAEAPNSNVIFSNIRFGPIGSTVSGLPDGG

SEQ ID NO: 462 - protein, 443 aa, Penicillium chrysogenum
QQVGTSTAEVHPSLTWQKCTAGGSCTSQSGKVVIDSNWRWVHNTGGYTNCYTGNDWDRTLCPDDVTCATNCALDGADYKGTYGVTASGSSLRLNFVTQASQKNIGSRLYLMADDSKYEMFQLLNQEFTFDVDVSNLPCGLNGALYFVAMDEDGGMARYPTNKAGAKYGTGYCDAQCPRDLKFINGQANVEGWEPSSSDVNGGTGNYGSCCAEMDIWEANSISTAFTPHPCDDPAQTRCTGDSCGGTYSSDRYGGTCDPDGCDFNPYRMGNQSFYGPSKIVDTESPFTVVTQFITNDGTSTGTLSEIKRFYVQNGKVIPQSVSTISAVTGNSITDSFCSAQKTAFKDTDVFAKHGGMAGMGAGLAEGMVLVMSLWDDHAANMLWLDSTYPTSASSTTPGAARGSCDISSGEPSDVEANHSNAYVVYSNIKVGPLGSTFGSTDSG

SEQ ID NO: 463 - protein, 447 aa, Aspergillus aculeatus
QQVGTYTAETHPSLTWQTCSGSGSCTTTSGSVVIDANWRWVHEVGGYTNCYSGNTWDSSICSTDTTCASECALEGATYESTYGVTTSGSSLRLNFVTTASQKNIGSRLYLLADDSTYETFKLFNREFTFDVDVSNLPCGLNGALYFVSMDADGGVSRFPTNKAGAKYGTGYCDSQCPRDLKFIDGQANIEGWEPSSTDVNAGTGNHGSCCPEMDIWEANSISSAFTAHPCDSVQQTMCTGDTCGGTYSDTTDRYSGTCDPDGCDFNPYRFGNTNFYGPGKTVDNSKPFTVVTQFITHDGTDTGTLTEIRRLYVQNGVVIGNGPSTYTAASGNSITESFCKAEKTLFGDTNVFETHGGLSAMGDALGDGMVLVLSLWDDHAADMLWLDSDYPTTSCASSPGVARGTCPTTTGNATYVEANYPNSYVTYSNIKFGTLNSTYSGTSSGGS

SEQ ID NO: 464 - protein, 445 aa, Aspergillus nidulans
QKVGTQQAEVHPGLTWQTCTSSGSCTTVNGEVTIDANWRWLHTVNGYTNCYTGNEWDTSICTSNEVCAEQCAVDGANYASTYGITTSGSSLRLNFVTQSQQKNIGSRVYLMDDEDTYTMFYLLNKEFTFDVDVSELPCGLNGAVYFVSMDADGGKSRYATNEAGAKYGTGYCDSQCPRDLKFINGVANVEGWESSDTNPNGGVGNHGSCCAEMDIWEANSISTAFTPHPCDTPGQTLCTGDSCGGTYSNDRYGGTCDPDGCDFNSYRQGNKTFYGPGLTVDTNSPVTVVTQFLTDDNTDTGTLSEIKRFYVQNGVVIPNSESTYPANPGNSITTEFCESQKELFGDVDVFSAHGGMAGMGAALEQGMVLVLSLWDDNYSNMLWLDSNYPTDADPTQPGIARGTCPTDSGVPSEVEAQYPNAYVVYSNIKFGPIGSTFGNGGGSGP

SEQ ID NO: 465 - protein, 445 aa, Emericella nidulans; identical to SEQ ID NO: 464

SEQ ID NO: 466 - protein, 442 aa, Thielavia australiensis
QAVCSLTAETHPSLTWQKCTAPGSCTNVAGSITIDANWRWTHQTSSATNCYSGSKWDSSICTTGTDCASKCCIDGAEYSSTYGITTSGNALNLKFVTKGQYSTNIGSRTYLMESDTKYQMFKLLGNEFTFDVDVSNLGCGLNGALYFVSMDADGGMSKYSGNKAGAKYGTGYCDAQCPRDLKFINGEANVEGWESSTNDANAGSGKYGSCCTEMDVWEANNMATAFTPHPCTTIGQTRCEGDTCGGTYSSDRYAGVCDPDGCDFNSYRQGNKTFYGKGMTVDTTKKITVVTQFLKNSAGELSEIKRFYAQDGKVIPNSESTIAGIPGNSITKAYCDAQKTVFQNTDDFTAKGGLVQMGKALAGDMVLVMSVWDDHAVNMLWLDSTYPTDQVGVAGAERGACPTTSGVPSDVEANAPNSNVIFSNIRFGPIGSTVQGLPSSGG

SEQ ID NO: 467 - protein, 442 aa, Chaetomium thermophilum
QQACSLTAENHPSLTWKRCTSGGSCSTVNGAVTIDANWRWTHTVSGSTNCYTGNQWDTSLCTDGKSCAQTCCVDGADYSSTYGITTSGDSLNLKFVTKHQYGTNVGSRVYLMENDTKYQMFELLGNEFTFDVDVSNLGCGLNGALYFVSMDADGGMSKYSGNKAGAKYGTGYCDAQCPRDLKFINGEANVGNWTPSTNDANAGFGRYGSCCSEMDVWEANNMATAFTPHPCTTVGQSRCEADTCGGTYSSDRYAGVCDPDGCDFNAYRQGDKTFYGKGMTVDTNKKMTVVTQFHKNSAGVLSEIKRFYVQDGKIIANAESKIPGNPGNSITQEYCDAQKVAFSNTDDFNRKGGMAQMSKALAGPMVLVMSVWDDHYANMLWLDSTYPIDQAGAPGAERGACPTTSGVPAEIEAQVPNSNVIFSNIRFGPIGSTVPGLDGSNP

SEQ ID NO: 468 - protein, 442 aa, Chaetomium thermophilum
QQACSLTTETHPRLTWKRCTSGGNCSTVNGAVTIDANWRWTHTVSGSTNCYTGNEWDTSICSDGKSCAQTCCVDGADYSSTYGITTSGDSLNLKFVTKHQHGTNVGSRVYLMENDTKYQMFELLGNEFTFDVDVSNLGCGLNGALYFVSMDADGGMSKYSGNKAGAKYGTGYCDAQCPRDLKFINGEANIENWTPSTNDANAGFGRYGSCCSEMDIWDANNMATAFTPHPCTIIGQSRCEGNSCGGTYSSERYAGVCDPDGCDFNAYRQGDKTFYGKGMTVDTTKKMTVVTQFHKNSAGVLSEIKRFYVQDGKIIANAESKIPGNPGNSITQEWCDAQKVAFGDIDDFNRKGGMAQMSKALEGPMVLVMSVWDDHYANMLWLDSTYPIDKAGTPGAERGACPTTSGVPAEIEAQVPNSNVIFSNIRFGPIGSTVPGLDGSTP

SEQ ID NO: 469 - protein, 438 aa, Acremonium thermophilum
QGVGTQQTETHPKLTFQKCSAAGSCTTQNGEVVIDANWRWVHDKNGYTNCYTGNEWNTTICADAASCASNCVVDGADYQGTYGASTSGNALTLKFVTKGSYATNIGSRMYLMASPTKYAMFTLLGHEFAFDVDLSKLPCGLNGAVYFVSMDEDGGTSKYPSNKAGAKYGTGYCDSQCPRDLKFIDGKANSASWQPSSNDQNAGVGGMGSCCAEMDIWEANSVSAAYTPHPCQNYQQHSCSGDDCGGTYSATRFAGDCDPDGCDWNAYRMGVHDFYGNGKTVDTGKKFSIVTQFKGSGSTLTEIKQFYVQDGRKIENPNATWPGLEPFNSITPDFCKAQKQVFGDPDRFNDMGGFTNMAKALANPMVLVLSLWDDHYSNMLWLDSTYPTDADPSAPGKGRGTCDTSSGVPSDVESKNGDATVIYSNIKFGPLDSTYTAS

SEQ ID NO: 470 - protein, 442 aa, Humicola grisea
QQACSLTTERHPSLSWNKCTAGGQCQTVQASITLDSNWRWTHQVSGSTNCYTGNKWDTSICTDAKSCAQNCCVDGADYTSTYGITTNGDSLSLKFVTKGQHSTNVGSRTYLMDGEDKYQTFELLGNEFTFDVDVSNIGCGLNGALYFVSMDADGGLSRYPGNKAGAKYGTGYCDAQCPRDIKFINGEANIEGWTGSTNDPNAGAGRYGTCCSEMDIWEANNMATAFTPHPCTIIGQSRCEGDSCGGTYSNERYAGVCDPDGCDFNSYRQGNKTFYGKGMTVDTTKKITVVTQFLKDANGDLGEIKRFYVQDGKIIPNSESTIPGVEGNSITQDWCDRQKVAFGDIDDFNRKGGMKQMGKALAGPMVLVMSIWDDHASNMLWLDSTFPVDAAGKPGAERGACPTTSGVPAEVEAEAPNSNVVFSNIRFGPIGSTVAGLPGAGN

SEQ ID NO: 471 - protein, 442 aa, Humicola grisea
QQACSLTTERHPSLSWKKCTAGGQCQTVQASITLDSNWRWTHQVSGSTNCYTGNKWDTSICTDAKSCAQNCCVDGADYTSTYGITTNGDSLSLKFVTKGQYSTNVGSRTYLMDGEDKYQTFELLGNEFTFDVDVSNIGCGLNGALYFVSMDADGGLSRYPGNKAGAKYGTGYCDAQCPRDIKFINGEANIEGWTGSTNDPNAGAGRYGTCCSEMDIWEANNMATAFTPHPCTIIGQSRCEGDSCGGTYSNERYAGVCDPDGCDFNSYRQGNKTFYGKGMTVDTTKKITVVTQFLKDANGDLGEIKRFYVQDGKIIPNSESTIPGVEGNSITQDWCDRQKVAFGDIDDFNRKGGMKQMGKALAGPMVLVMSIWDDHASNMLWLDSTFPVDAAGKPGAERGACPTTSGVPAEVEAEAPNSNVVFSNIRFGPIGSTVAGLPGAGN

SEQ ID NO: 472 - protein, 437 aa, Claviceps purpurea
QQACSSKPETHPPLSWSRCSRSGCRSVQGAVTVDANWLWTTVDGSQNCYTGNRWDTSICSSEKTCSESCCIDGADYAGTYGVTTTGDALSLKFVQQGPYSKNVGSRLYLMKDESRYEMFTLLGNEFTFDVDVSKLGCGLNGALYFVSMDEDGGMKRFPMNKAGAKFGTGYCDSQCPRDVKFINGMANSKDWIPSKSDANAGIGSLGACCREMDIWEANNIASAFTPHPCKNSAYHSCTGDGCGGTYSKNRYSGDCDPDGCDFNSYRLGNTTFYGPGPKFTIDTTRKISVVTQFLKGRDGSLREIKRFYVQNGKVIPNSVSRVRGVPGNSITQGFCNAQKKMFGAHESFNAKGGMKGMSAAVSKPMVLVMSLWDDHNSNMLWLDSTYPTNSRQRGSKRGSCPASSGRPTDVESSAPDSTVVFSNIKFGPIGSTFSRGK

SEQ ID NO: 473 - protein, 438 aa, Cochliobolus carbonum
QQVGTSTAENHPKLTWQTCTGTGGTNCSNKSGSVVLDSNWRWAHNVGGYTNCYTGNSWSTQYCPDGDSCTKNCAIDGADYSGTYGITTSNNALSLKFVTKGSFSSNIGSRTYLMETDTKYQMFNLINKEFTFDVDVSKLPCGLNGALYFVEMAADGGIGKGNNKAGAKYGTGYCDSQCPHDIKFINGKANVEGWNPSDADPNGGAGKIGACCPEMDIWEANSISTAYTPHPCRGVGLQECSDAASCGDGSNRYDGQCDKDGCDFNSYRMGVKDFYGPGATLDTTKKMTVITQFLGSGSSLSEIKRFYVQNGKVYKNSQSAVAGVTGNSITESFCTAQKKAFGDTSSFAALGGLNEMGASLARGHVLIMSLWGDHAVNMLWLDSTYPTDADPSKPGAARGTCPTTSGKPEDVEKNSPDATVVFSNIKFGPIGSTFAQPA

SEQ ID NO: 474 - protein, 431 aa, Phanerochaete chrysosporium
QQVGTNTAENHRTLTSQKCTKSGGCSNLNTKIVLDANWRWLHSTSGYTNCYTGNQWDATLCPDGKTCAANCALDGADYTGTYGITASGSSLKLQFVTGSNVGSRVYLMADDTHYQMFQLLNQEFTFDVDMSNLPCGLNGALYLSAMDADGGMAKYPTNKAGAKYGTGYCDSQCPRDIKFINGEANVEGWNATSANAGTGNYGTCCTEMDIWEANNDAAAYTPHPCTTNAQTRCSGSDCTRDTGLCDADGCDFNSFRMGDQTFLGKGLTVDTSKPFTVVTQFITNDGTSAGTLTEIRRLYVQNGKVIQNSSVKIPGIDPVNSITDNFCSQQKTAFGDTNYFAQHGGLKQVGEALRTGMVLALSIWDDYAANMLWLDSNYPTNKDPSTPGVARGTCATTSGVPAQIEAQSPNAYVVFSNIKFGDLNTTYTGTV

SEQ ID NO: 475 - protein, 445 aa, Fusicoccum sp.
QQVGTQTAETHPKLTTQKCTTAGGCTDQSTSIVLDANWRWLHTVDGYTNCYTGQEWDTSICTDGKTCAEKCALDGADYESTYGISTSGNALTMNFVTKSSQTNIGGRVYLLAADSDDTYELFKLKNQEFTFDVDVSNLPCGLNGALYFSEMDSDGGLSKYTTNKAGAKYGTGYCDTQCPHDIKFINGEANVQNWTASSTDKNAGTGHYGSCCNEMDIWEANSQATAFTPHVCEAKVEGQYRCEGTECGDGDNRYGGVCDKDGCDFNSYRMGNETFYGSNGSTIDTTKKFTVVTQFITADNTATGALTEIRRKYVQNDVVIENSYADYETLSKFNSITDDFCAAQKTLSGDTNDFKTKGGIARMGESFERGMVLVMSVWDDHAANALWLDSSYPTDADASKPGVKRGPCSTSSGVPSDVEANDADSSVIYSNIRYGDIGSTFNKTA

SEQ ID NO: 476 - protein, 440 aa, Irpex lacteus
QQVGTNQAENHPSLPSQKCTASGCTTSSTSVVLDANWRWVHTTTGYTNCYTGQTWDASICPDGVTCAKACALDGADYSGTYGITTSGNALTLQFVKGTNVGSRVYLLQDASNYQMFQLINQEFTFDVDMSNLPCGLNGAVYLSQMDQDGGVSRFPTNTAGAKYGTGYCDSQCPRDIKFINGEANVEGWTGSSTDSNSGTGNYGTCCSEMDIWEANSVAAAYTPHPCSVNQQTRCTGADCGQGDDRYDGVCDPDGCDFNSFRMGDQTFLGKGLTVDTSRKFTIVTQFISDDGTTSGNLAEIRRFYVQDGNVIPNSKVSIAGIDAVNSITDDFCTQQKTAFGDTNRFAAQGGLKQMGAALKSGMVLALSLWDDHAANMLWLDSDYPTTADASNPGVARGTCPTTSGFPRDVESQSGSATVTYSNIKWGDLNSTFTGTLTTPS

SEQ ID NO: 477 - protein, 431 aa, Phanerochaete chrysosporium
QQAGTNTAENHPQLQSQQCTTSGGCKPLSTKVVLDSNWRWVHSTSGYTNCYTGNEWDTSLCPDGKTCAANCALDGADYSGTYGITSTGTALTLKFVTGSNVGSRVYLMADDTHYQLLKLLNQEFTFDVDMSNLPCGLNGALYLSAMDADGGMSKYPGNKAGAKYGTGYCDSQCPKDIKFINGEANVGNWTETGSNTGTGSYGTCCSEMDIWEANNDAAAFTPHPCTTTGQTRCSGDDCARNTGLCDGDGCDFNSFRMGDKTFLGKGMTVDTSKPFTVVTQFLTNDNTSTGTLSEIRRIYIQNGKVIQNSVANIPGVDPVNSITDNFCAQQKTAFGDTNWFAQKGGLKQMGEALGNGMVLALSIWDDHAANMLWLDSDYPTDKDPSAPGVARGTCATTSGVPSDVESQVPNSQVVFSNIKFGDIGSTFSGTS

SEQ ID NO: 478 - protein, 435 aa, Irpex lacteus
QQVGTQMAEVHPKLPSQLCTKSGCTNQNTAVVLDANWRWLHTTSGYTNCYTGNSWDATLCPDATTCAQNCAVDGADYSGTYGITTSGNALTLKFKTGTNVGSRVYLMQTDTAYQMFQLLNQEFTFDVDMSNLPCGLNGALYLSQMDQDGGLSKFPTNKAGAKYGTGYCDSQCPHDIKFINGMANVAGWAGSASDPNAGSGTLGTCCSEMDIWEANNDAAAFTPHPCSVDGQTQCSGTQCGDDDERYSGLCDKDGCDFNSFRMGDKSFLGKGMTVDTSRKFTVVTQFVTTDGTTNGDLHEIRRLYVQDGKVIQNSVVSIPGIDAVDSITDNFCAQQKSVFGDTNYFATLGGLKKMGAALKSGMVLAMSVWDDHAASMQWLDSNYPADGDATKPGVARGTCSADSGLPTNVESQSASASVTFSNIKWGDINTTFTGT

SEQ ID NO: 479 - protein, 429 aa, Humicola grisea
QQAGTITAENHPRMTWKRCSGPGNCQTVQGEVVIDANWRWLHNNGQNCYEGNKWTSQCSSATDCAQRCALDGANYQSTYGASTSGDSLTLKFVTKHEYGTNIGSRFYLMANQNKYQMFTLMNNEFAFDVDLSKVECGINSALYFVAMEEDGGMASYPSNRAGAKYGTGYCDAQCARDLKFIGGKANIEGWRPSTNDPNAGVGPMGACCAEIDVWESNAYAYAFTPHACGSKNRYHICETNNCGGTYSDDRFAGYCDANGCDYNPYRMGNKDFYGKGKTVDTNRKFTVVSRFERNRLSQFFVQDGRKIEVPPPTWPGLPNSADITPELCDAQFRVFDDRNRFAETGGFDALNEALTIPMVLVMSIWDDHHSNMLWLDSSYPPEKAGLPGGDRGPCPTTSGVPAEVEAQYPNAQVVWSNIRFGPIGSTVNV

SEQ ID NO: 480 - protein, 429 aa, Chaetomium thermophilum
QRAGTQQTETHPRLSWKRCSSGGNCQTVNAEIVIDANWRWLHDSNYQNCYDGNRWTSACSSATDCAQKCYLEGANYGSTYGVSTSGDALTLKFVTKHEYGTNIGSRVYLMNGSDKYQMFTLMNNEFAFDVDLSKVECGLNSALYFVAMEEDGGMRSYSSNKAGAKYGTGYCDAQCARDLKFVGGKANIEGWRPSTNDANAGVGPYGACCAEIDVWESNAYAFAFTPHGCLNNNYHVCETSNCGGTYSEDRFGGLCDANGCDYNPYRMGNKDFYGKGKTVDTSRKFTVVTRFEENKLTQFFIQDGRKIDIPPPTWPGLPNSSAITPELCTNLSKVFDDRDRYEETGGFRTINEALRIPMVLVMSIWDGHYASMLWLDSVYPPEKAGQPGAERGPCAPTSGVPAEVEAQFPNAQVIWSNIRFGPIGSTYQV

SEQ ID NO: 481 - protein, 429 aa, Humicola grisea
QQAGTITAENHPRMTWKRCSGPGNCQTVQGEVVIDANWRWLHNNGQNCYEGNKWTSQCSSATDCAQRCALDGANYQSTYGASTSGDSLTLKFVTKHEYGTNIGSRFYLMANQNKYQMFTLMNNEFAFDVDLSKVECGINSALYFVAMEEDGGMASYPSNRAGAKYGTGYCDAQCARDLKFIGGKANIEGWRPSTNDPNAGVGPMGACCAEIDVWESNAYAYAFTPHACGSKNRYHICETNNCGGTYSDDRFAGYCDANGCDYNPYRMGNKDFYGKGKTVDTNRKFTVVSRFERNRLSQFFVQDGRKIEVPPPTWPGLPNSADITPELCDAQFRVFDDRNRFAETGGFDALNEALTIPMVLVMSIWDDHHSNMLWLDSSYPPEKAGLPGGDRGPCPTTSGVPAEVEAQYPDAQVVWSNIRFGPIGSTVNV

SEQ ID NO: 482 - protein, 432 aa, Magnaporthe grisea
QQVGTNEPEVHPKMTWKKCSSGGSCSTVNGEVVIDGNWRWIHNIGGYENCYSGNKWTSVCSTNADCATKCAMEGAKYQETYGVSTSGDALTLKFVQQNSSGKNVGSRMYLMNGANKYQMFTLKNNEFAFDVDLSSVECGMNSALYFVPMKEDGGMSTEPNNKAGAKYGTGYCDAQCARDLKFIGGKGNIEGWQPSSTDSSAGIGAQGACCAEIDIWESNKNAFAFTPHPCENNEYHVCTEPNCGGTYADDRYGGGCDANGCDYNPYRMGNPDFYGPGKTIDTNRKFTVISRFENNRNYQILMQDGVAHRIPGPKFDGLEGETGELNEQFCTDQFTVFDERNRFNEVGGWSKLNAAYEIPMVLVMSIWSDHFANMLWLDSTYPPEKAGQPGSARGPCPADGGDPNGVVNQYPNAKVIWSNVRFGPIGSTYQVD

SEQ ID NO: 483 - protein, 430 aa, Melanocarpus albomyces
QRAGNETPENHPPLTWQRCTAPGNCQTVNAEVVIDANWRWLHDDNMQNCYDGNQWTNACSTATDCAEKCMIEGAGDYLGTYGASTSGDALTLKFVTKHEYGTNVGSRFYLMNGPDKYQMFNLMGNELAFDVDLSTVECGINSALYFVAMEEDGGMASYPSNQAGARYGTGYCDAQCARDLKFVGGKANIEGWKSSTSDPNAGVGPYGSCCAEIDVWESNAYAFAFTPHACTTNEYHVCETTNCGGTYSEDRFAGKCDANGCDYNPYRMGNPDFYGKGKTLDTSRKFTVVSRFEENKLSQYFIQDGRKIEIPPPTWEGMPNSSEITPELCSTMFDVFNDRNRFEEVGGFEQLNNALRVPMVLVMSIWDDHYANMLWLDSIYPPEKEGQPGAARGDCPTDSGVPAEVEAQFPDAQVVWSNIRFGPIGSTYDF

SEQ ID NO: 484 - protein, 430 aa, Phanerochaete chrysosporiu
QQVGTYIPENHPLLATQSCTASGGCTTSSSKIVLDANRRWIHSTLGTTSCLTANGWDPTLCPDGITCANYCALDGVSYSSTYGITTSGSALRLQFVTGTNIGSRVFLMADDTHYRTFQLLNQELAFDVDVSKLPCGLNGALYFVAMDADGGKSKYPGNRAGAKYGTGYCDSQCPRDVQFINGQANVQGWNATSATTGTGSYGSCCTELDIWEANSNAAALTPHTCTNNAQTRCSGSNCTSNTGFCDADGCDFNSFRLGNTTFLGAGMSVDTTKTFTVVTQFITSDNTSTGNLTEIRRFYVQNGNVIPNSVVNVTGIGAVNSITDPFCSQQKKAFIETNYFAQHGGLAQLGQALRTGMVLAFSISDDPANHMLWLDSNFPPSANPAVPGVARGMCSITSGNPADVGILNPSPYVSFLNIKFGSIGTTFRPA

SEQ ID NO: 485 - protein, 465 aa, Volvariella volvacea
QQAGTLQTKNHPSLTSQKCRQGGCPQVNTTIVLDANWRWTHSTSGSTNCYTGNTWQATLCPDGKTCAANCALDGADYTGTYGVTTSGNSLTLQFVTQSNVGARLGYLMADDTTYQMFNLLNQEFWFDVDMSNLPCGLNGALYFSAMARTAAWMPMVVCASTPLISTRRSTARLLRLPVPPRSRYGRGICDSQCPRDIKFINGEANVQGWQPSPNDTNAGTGNYGACCNKMDVWEANSISTAYTPHPCTQRGLVRCSGTACGGGSNRYGSICDHDGLGFQNLFGMGRTRVRARVGRVKQFNRSSRVVEPISWTKQTTLHLGNLPWKSADCNVQNGRVIQNSKVNIPGMPSTMDSVTTEFCNAQKTAFNDTFSFQQKGGMANMSEALRRGMVLVLSIWDDHAANMLWLDSITSAAACRSTPSEVHATPLRESQIRSSHSRQTRYVTFTNIKFGPFNSTGTTYTTGSV

SEQ ID NO: 486 - protein, 36 aa, Hypocrea koningii
TQSHYGQCGGIGYSGPTVCASGTTCQVLNPYYSQCL

SEQ ID NO: 487 - protein, 36 aa, Hypocrea rufa; identical to SEQ ID NO: 486

SEQ ID NO: 488 - protein, 36 aa, Hypocrea rufa
TQTHYGQCGGIGYSGPTVCASGSTCQVLNPYYSQCL

SEQ ID NO: 489 - protein, 36 aa, Hypocrea rufa
TQTHYGQCGGIGYIGPTVCASGSTCQVLNPYYSQCL

SEQ ID NO: 490 - protein, 36 aa, Penicillium funiculosum
VAAHWGQCGGQGWTGPTTCASGTTCTVVNPYYSQCL

SEQ ID NO: 491 - protein, 35 aa, Volvariella volvacea
TVPQGQCGGIGYTGPTTCASPTTCHVLNPYYSQCY

SEQ ID NO: 492 - protein, 36 aa, Penicillium occitanis
VAGHWGQCGGQGWTGPTTCVSGTTCTVVNPYYSQCL

SEQ ID NO: 493 - protein, 36 aa, Phanerochaete chrysosporium
TVPQWGQCGGIGYTGSTTCASPYTCHVLNPYYSQCY

SEQ ID NO: 494 - protein, 35 aa, Aspergillu aculeatus
VAQLYGQCGGQGWTGPTTCASGTCTKQNDYYSQCL

SEQ ID NO: 495 - protein, 36 aa, Chaetomium thermophilum
TTQKWGQCGGIGYTGCTNCVAGTTCTQLNPWYSQCL

SEQ ID NO: 496 - protein, 36 aa, Chaetomium thermophilum
TTQKWGQCGGIGYTGCTNCVAGTTCTELNPWYSQCL

SEQ ID NO: 497 - protein, 36 aa, Irpex lacteus
TVAQWGQCGGTGFTGPTVCASPFTCHVVNPYYSQCY

SEQ ID NO: 498 - protein, 36 aa, Acremonium thermophilum
QQTHWGQCGGQGWTGPTVCQSPYTCKYSNDWYSQCL

SEQ ID NO: 499 - protein, 36 aa, Aspergillus niger
AAQAYGQCGGQGWTGPTTCVSGYTCTYENAYYSQCL

SEQ ID NO: 500 - protein, 36 aa, Chrysosporium lucknowense
VAKHYEQCGGIGFTGPTQCESPYTCTKLNDWYSQCL

SEQ ID NO: 501 - protein, 36 aa, Aspergillus nidulans
QAQHWEQCGGNGWTGPTVCASPWACTVVNSWYSQCL

SEQ ID NO: 502 - protein, 36 aa, Emericella nidulans; identical to SEQ ID NO: 501

SEQ ID NO: 503 - protein, 36 aa, Irpex lacteus
TVAQWAQCGGIGYSGATTCVSPYTCHVVNAYYSQCY

SEQ ID NO: 504 - protein, 36 aa, Penicillium chrysogenum
GAAHYAQCGGQNWTGPTTCASPYTCQRQGDYYSQCL

SEQ ID NO: 505 - protein, 36 aa, Phanerochaete chrysosporium
TVPQWGQCGGIGYSGSTTCASPYTCHVLNPCESILS

SEQ ID NO: 506 - protein, 36 aa, Humicola grisea
KAGRWQQCGGIGFTGPTQCEEPYTCTKLNDWYSQCL

SEQ ID NO: 507 - protein, 36 aa, Thielavia australiensis
TAKHWQQCGGNGWTGPTVCESPYKCTKQNDWYSQCL

SEQ ID NO: 508 - protein, 36 aa, Humicola grisea
KAGRWQQCGGIGFTGPTQCEEPYICTKLNDWYSQCL

SEQ ID NO: 509 - protein, 36 aa, Penicillium janthinellum
GARDWAQCGGNGWTGPTTCVSPYTCTKQNDWYSQCL

The invention claimed is:

1. An isolated cellobiohydrolase enzyme comprising a modified Family 7 catalytic domain, the modified Family 7 catalytic domain comprising one or more amino acid substitution selected from the group consisting of: X46A, X46L, X46T, X51I, X52R, X52W, X53A, X53M, X53R, X53W, X54S, X54I, X54D, X75S, X87T, X93V, X95L, X95Y, X102R, X111T, X129S, X130N, X130E, X139E, X139M, X139Q, X139S, X139R, X143L, X143G, X144A, X144V, X150N, X181L, X183N, X184S, X197L, X197V, X197Q, X197W, X219S, X237T, X241L, X241R, X241V, X253R, X260D, X264C, X264Y, X271I, X343L, X351R, X353M, X374V, X375A, X378E, X379C, X379E, X382L, X382Q, X382I, X383S, X385I, X385L, X390A, X390G, X390K, X390W, X390C, X390L, X390V, X406P, and X419F, wherein the modified Family 7 catalytic domain comprises an amino acid sequence that exhibits from about 80% to about 99.9% identical to amino acids 1-436 of SEQ ID NO: 1 or to amino acids 1-438 of SEQ ID NO: 2, and wherein the isolated cellobiohydrolase enzyme exhibits
 a. increased specific activity,
 b. reduced inhibition by glucose,
 c. reduced inactivation by lignin,
 d. increased activity in the presence of lignin,
 e. increased activity in the presence of lignocellulose hydrolysate, or
 f. any combination of a through e,
 relative to a cellobiohydrolase comprising a corresponding parental Family 7 catalytic domain from which the modified Family 7 catalytic domain is obtained.

2. The isolated cellobiohydrolase claim 1, further comprising a carbohydrate binding module and a linker peptide positioned between the modified Family 7 catalytic domain and the carbohydrate binding module.

3. The isolated cellobiohydrolase of claim 2, wherein the carbohydrate binding module is a Family 1 carbohydrate binding module exhibiting from about 50% to about 99% identity to amino acids 461 to 497 of SEQ ID NO: 1 or to amino acids 474 to 509 of SEQ ID NO: 2 and comprising one or more amino acid substitutions selected from the group consisting of X467D, X471S, X483V, X483S, X486R, X489T, and X489Q, said position determined from alignment of a parental Family 1 carbohydrate binding module with amino acids 461 to 497 of SEQ ID NO: 1.

4. An isolated cellobiohydrolase comprising a Family 7 catalytic domain, a modified Family 1 carbohydrate binding module, and a linker peptide between the Family 7 catalytic domain and the modified Family 1 carbohydrate binding module, wherein the modified Family 1 carbohydrate binding module exhibits from about 50% to about 99% identity to amino acids 461 to 497 of SEQ ID NO: 1 or to amino acids 474 to 509 of SEQ ID NO: 2 and comprises one or more amino acid substitutions selected from the group consisting of X467D, X471S, X483V, X483S, X486R, X489T, and X489Q, said position determined from alignment of a parental Family 1 carbohydrate binding module with amino acids 461 to 497 of SEQ ID NO: 1, and wherein the isolated cellobiohydrolase exhibits
 a. increased specific activity,
 b. reduced inhibition by glucose,
 c. reduced inactivation by lignin,
 d. increased activity in the presence of lignin,
 e. increased activity in the presence of lignocellulose hydrolysate, or
 f. any combination of a through e,
 relative to a cellobiohydrolase comprising a corresponding parental Family 1 carbohydrate binding module from which the modified Family 1 carbohydrate binding module is obtained.

5. An isolated *Trichoderma reesei* TrCel7A cellobiohydrolase comprising one or more amino acid substitution selected from the group consisting of: T26X, R39L, N45D, Y51I, G53X, N54X, G75X, F95X, A100X, K102X, L108X, M111X, F129X, D130X, V131X, P137X, G139X, A143X, L144X, D150X, S156X, K181X, I183X, N184X, P194X, N197X, N200X, C209X, S211X, N219X, D241X, G260X, N264X, N324X, G339X, F343X, Q351X, G358X, A372X, M374X, L375X, D378X, S379X, P382X, P390X, V393X, S419X, N420X, F423X, N431X, G435X, P437X, N441X, G444X, T446X, T447X, T453X, T454X, T455X, P459X, Q463X, G467X, G471X, S475X, G476X, S482X, G483X, G483X, C486X, V488X, and L489X, wherein the isolated *Trichoderma reesei* TrCel7A cellobiohydrolase comprises an amino acid sequence that is from about 75% to about 99.9% identical to amino acids 1-497 of SEQ ID NO: 1 and exhibits
 a. increased specific activity,
 b. reduced inhibition by glucose,
 c. reduced inactivation by lignin,
 d. increased activity in the presence of lignin,
 e. increased activity in the presence of lignocellulose hydrolysate, or
 f. any combination of a through e,
 relative to a corresponding parental *Trichoderma reesei* TrCel7A cellobiohydrolase from which the isolated *Trichoderma reesei* TrCel7A cellobiohydrolase is obtained.

6. An isolated *Trichoderma reesei* TrCel7A cellobiohydrolase comprising one or more amino acid substitution selected from the group consisting of T26A, T26S, R39L, N45D, S46A, S46I, S46L, S46T, Y51I, D52R, D52W, G53A, G53M, G53R, G53W, N54S, N54I, N54D, G75S, S87T, I93V, F95L, F95Y, A100T, A100V, A100W, A100L, A100G, K102S, K102R, L108I, M111T, D114E, F129S, D130N, D130E, V131A, P137S, G139E, G139M, G139Q, G139S, G139R, A143L, A143G, L144A, L144V, D150N, V155M, S156G, K181L, I183N, N184S, P194Q, N197L, N197V, N197Q, N197W, N197A, N200F, N200C, C209S, S211T, N219S, I237T, D241L, D241R, D241OV, G253D, G253R, G260D, N264Y, T271I, L282I, P314A, A316V, N324D, G339D, F343L, Q351R, K353M, G358S, D368A, D368G, A372T, N373Y, M374V, L375A, D378E, S379C, S379E, P382L, P382Q, P382I, T383S, T383A, E385G, E385I, E385L, P390A, P390G, P390K, P390W, P390C, P390L, P390V, V393A, Q406P, S419F, N420D, F423Y, N431R, G435S, N436D, P437T, N441D, G444D, T446A, T447S, R450S, T453I, T453S, T454I, T455A, P459L, Q463L, Q463S, Q463K, Y466S, G467D, G471S, S475N, G476D, S482N, G483V, G483S, C486R, V488D, L489P, and L489Q, wherein the isolated *Trichoderma reesei* TrCel7A cellobiohydrolase comprises an amino acid sequence that is from about 80% to about 99.9% identical to amino acids 1-497 of SEQ ID NO: 1 and exhibits
 a. increased specific activity,
 b. reduced inhibition by glucose,
 c. reduced inactivation by lignin,
 d. increased activity in the presence of lignin,
 e. increased activity in the presence of lignocellulose hydrolysate, or
 f. any combination of a through e, relative to a corresponding parental *Trichoderma reesei* TrCel7A cellobiohydrolase from which the isolated *Trichoderma reesei* TrCel7A cellobiohydrolase is obtained.

7. The isolated *Trichoderma reesei* TrCel7A cellobiohydrolase of claim 6, comprising one or more amino acid substitution selected from the group consisting of: T26S, R39L, N45D, S46A, S46L, S46T, D52R, G53A, G53M, G53R, G53W, N54S, N54I, N54D, S87T, A100T, A100V, A100W, A100L, A100G, K102R, F129S, D130N, G139M, G139S, G139R, A143L, A143G, L144V, I183N, N184S, N197L, N197V, N197Q, N197W, N197A, N200F, N200C, I237T, D241L, D241R, D241V, G253D, G253R, N264Y, T271I, L282I, P314A, A316V, N324D, G339D, F343L, G358S, D368A, D368G, A372T, S379C, P382L, P382Q, P382I, T383S, T383A, E385G, E385I, E385L, P390A, P390G, P390K, P390W, P390C, P390L, P390V, V393A, Q406P, F423Y, N431R, P437T, T446A, T447S, T454I, G467D, S475N, and G483V, wherein the isolated *Trichoderma reesei* TrCel7A cellobiohydrolase comprises an amino acid sequence that is from about 90% to about 99.9% identical to amino acids 1-497 of SEQ ID NO: 1.

8. A genetic construct comprising a nucleic acid sequence encoding
 a. the isolated cellobiohydrolase of claim 1, or
 b. the isolated *Trichoderma reesei* TrCel7A cellobiohydrolase claim 5.

9. A genetically modified microbe comprising the genetic construct of claim 8.

10. The genetically modified microbe of claim 9, wherein the microbe is a species of yeast or filamentous fungus.

11. The genetically modified microbe of claim 10, wherein the microbe is a species of *Streptomyces, Saccharomyces, Pichia, Hansenula, Hypocrea, Trichoderma, Aspergillus, Fusarium, Chrysosporium, Sporotrichum, Myceliophthora*, or a taxonomically equivalent genus thereof.

12. A process for producing an isolated cellobiohydrolase comprising,
 a. transforming a host microbe with a genetic construct comprising a nucleic acid sequence encoding (i) the isolated cellobiohydrolase of claim 1, or (ii) the isolated *Trichoderma reesei* TrCel7A cellobiohydrolase of claim 5;
 b. selecting a genetically modified microbe expressing the isolated cellobiohydrolase; and
 c. culturing the genetically modified microbe under conditions that enable the expression of the isolated cellobiohydrolase from the genetic construct.

13. A cellulase enzyme mixture comprising a cellulase enzyme mixture comprising
 a. the isolated cellobiohydrolase of claim 1, or
 b. the isolated *Trichoderma reesei* TrCel7A cellobiohydrolase of claim 5.

14. A process for the hydrolyzing a cellulose substrate comprising contacting the substrate with the cellulase enzyme mixture of claim 13.

15. The process of claim 14, wherein the cellulose substrate is a pretreated lignocellulosic feedstock.

16. The process of claim 15, wherein the pretreated lignocellulose feedstock is selected from the group consisting of corn stover, wheat straw, barley straw, rice straw, oat straw, canola straw, soybean stover, corn fiber, sugar beet pulp, pulp mill fines and rejects, sugar cane bagasse, hardwood, softwood, sawdust, switch grass, miscanthus, cord grass, and reed canary grass.

17. The isolated *Trichoderma reesei* TrCel7A cellobiohydrolase of claim 6, wherein the amino acid substitution is N45D and D52R.

18. The isolated *Trichoderma reesei* TrCel7A cellobiohydrolase of claim 6, wherein the amino acid substitution is S46T.

19. The isolated *Trichoderma reesei* TrCel7A cellobiohydrolase of claim 6, wherein the amino acid substitution is P390G.

20. The isolated *Trichoderma reesei* TrCel7A cellobiohydrolase of claim 6, wherein the amino acid substitution is D52W.

21. The isolated *Trichoderma reesei* TrCel7A cellobiohydrolase of claim 6, wherein the amino acid substitution is D241R.

22. The isolated *Trichoderma reesei* TrCel7A cellobiohydrolase of claim 6, wherein the amino acid substitution is G139Q.

23. The isolated *Trichoderma reesei* TrCel7A cellobiohydrolase of claim 6, wherein the amino acid substitution is P137S and K353M.

24. The isolated *Trichoderma reesei* TrCel7A cellobiohydrolase of claim 6, wherein the amino acid substitution is A143G.

25. The isolated *Trichoderma reesei* TrCel7A cellobiohydrolase of claim 6, wherein the amino acid substitution is A372T and V393A.

\* \* \* \* \*